(12) United States Patent
Richard et al.

(10) Patent No.: US 11,534,451 B2
(45) Date of Patent: Dec. 27, 2022

(54) NUCLEIC ACID OLIGOMERS AND USES THEREFOR

(71) Applicant: REPLUCA PTY LTD, Brisbane (AU)

(72) Inventors: Derek Richard, Ferny Grove (AU); Kenneth O'Byrne, Cleveland (AU); Laura Croft, Morningside (AU); Sam Beard, Rochedale South (AU)

(73) Assignee: REPLUCA PTY LTD, Brisbane (AU)

( * ) Notice: Subject to any disclaimer, the term of this patent is extended or adjusted under 35 U.S.C. 154(b) by 339 days.

(21) Appl. No.: 16/064,192

(22) PCT Filed: Dec. 23, 2016

(86) PCT No.: PCT/AU2016/051280
§ 371 (c)(1),
(2) Date: Jun. 20, 2018

(87) PCT Pub. No.: WO2017/106926
PCT Pub. Date: Jun. 29, 2017

(65) Prior Publication Data
US 2020/0230168 A1    Jul. 23, 2020

(30) Foreign Application Priority Data

Dec. 23, 2015 (AU) ................ 2015905380

(51) Int. Cl.
| | | |
|---|---|---|
| C07H 21/04 | (2006.01) | |
| A61K 31/7125 | (2006.01) | |
| A61P 35/00 | (2006.01) | |
| A61K 45/06 | (2006.01) | |
| C12N 15/115 | (2010.01) | |
| C12N 15/113 | (2010.01) | |

(52) U.S. Cl.
CPC .......... *A61K 31/7125* (2013.01); *A61K 45/06* (2013.01); *A61P 35/00* (2018.01); *C12N 15/113* (2013.01); *C12N 15/115* (2013.01); *C12N 2310/11* (2013.01); *C12N 2310/315* (2013.01); *C12N 2310/321* (2013.01); *C12N 2310/346* (2013.01)

(58) Field of Classification Search
CPC .......... C12N 15/113; C12N 2310/11
See application file for complete search history.

(56) References Cited

U.S. PATENT DOCUMENTS

| | | |
|---|---|---|
| 8,895,509 B2 | 11/2014 | McDonald et al. |
| 2003/0096776 A1 | 5/2003 | Hanecak et al. |
| 2013/0059015 A1 | 3/2013 | Lancaster et al. |

FOREIGN PATENT DOCUMENTS

| | | |
|---|---|---|
| CN | 1253179 A | 5/2000 |
| CN | 102000346 | 4/2011 |
| EP | 2487240 | 8/2012 |
| WO | WO 1994/08053 | 4/1994 |
| WO | WO 2000/61597 | 10/2000 |
| WO | WO 2004/012654 | 2/2004 |
| WO | WO 2005/042018 | 5/2005 |
| WO | WO 2009/047488 | 4/2009 |
| WO | WO 2013/170385 | 11/2013 |

OTHER PUBLICATIONS

Bates et al., Discovery and development of the G-rich oligonucleotide AS1411 as a novel treatment for cancer. Exp Mol Pathol. 2009;86:151-64.
Dapic et al., Antiproliferative Activity of G-Quartet-Forming Oligonucleotides with Backbone and Sugar Modifications. Biochem 2002;41:3676-85.
Mou et al., The high binding affinity of phosphorothioate-modified oligomers for Ff gene 5 protein is moderated by the addition of C-5 propyne of 2'-O-methyl modifications. Nucleic Acid Res 2002;30(3):749-58.
Baumann et al., miRNA-based Therapies: Strategies and Delivery Platforms for Oligonucleotide and Non-Oligonucleotide Agents. Future Med Chem. 2014;6(17):1967-84.
Cheng et al., Interactions Between Single-Stranded DNA Binding Protein and Oligonucleotide Analogs With Different Backbone Chemistries. J Mol Recognit. Mar.-Apr. 1997;10(2):101-7.
Merlini et al., Improving Clinical Trial Design for Duchenne Muscular Dystrophy. BMC Neurol. Aug. 26, 2015;15:153.
Richard et al., Single-stranded DNA-binding Protein hSSB1 Is Critical for Genomic Stability. Nature. May 29, 2008;453(7195):677-81.
Rothschild, microRNA Therapies in Cancer. Mol Cell Ther. Mar. 4, 2014;2:7.
Yoo et al., 2'-O-methyl-modified Phosphorothioate Antisense Oligonucleotides Have Reduced Non-Specific Effects in Vitro. Nucleic Acids Res. Apr. 2, 2004;32(6):2008-16.
Supplementary European Search Report for EP16877015, dated Mar. 20, 2020, 18 pages.
International Preliminary Report on Patentability for PCT/AU2016/051280, dated Apr. 12, 2017, 9 pages.
Dominguez-Sanchez et al., Differential expression of THOC1 and ALY mRNP biogenesis/export factors in human cancers. BMC Cancer. Feb. 17, 2011;11:77.
Kelley et al., Targeting DNA repair pathways for cancer treatment: what's new? Future Oncol. May 2014;10(7):1215-37.

(Continued)

*Primary Examiner* — Amy H Bowman

(74) *Attorney, Agent, or Firm* — Casimir Jones, S.C.; Mary Ann D. Brow

(57) ABSTRACT

Disclosed are nucleic acid oligomer compounds and to their use in compositions and methods for inhibiting proliferation, survival or viability of cancer cells including prostate, lung, pancreatic, breast, cervical and bone cancer cells.

7 Claims, 20 Drawing Sheets

Specification includes a Sequence Listing.

(56) References Cited

OTHER PUBLICATIONS

Saito et al., ALY as a potential contributor to metastasis in human oral squamous cell carcinoma. J Cancer Res Clin Oncol. Apr. 2013;139(4):585-94.
Xu et al., hSSB1 regulates both the stability and the transcriptional activity of p53. Cell Res. Mar. 2013;23(3):423-35.

NUCLEIC ACID OLIGOMERS AND USES THEREFOR

FIELD OF THE INVENTION

This application claims priority to Australian Provisional Application No. 2015905380 entitled "Nucleic acid oligomers and uses therefor" filed 23 Dec. 2015, the contents of which are incorporated herein by reference in their entirety.

SEQUENCE LISTING

The text of the computer readable sequence listing filed herewith, titled "36576-251_SEQUENCE_LISTING_ST25", created Jun. 23, 2021, having a file size of 715,461 bytes, is hereby incorporated by reference in its entirety.

This invention relates generally to nucleic acid oligomer compounds and to their use in compositions and methods for inhibiting proliferation, survival or viability of cancer cells including prostate, lung, pancreatic, breast, cervical and bone cancer cells.

BACKGROUND OF THE INVENTION

Cancer is the single biggest health problem globally. It is estimated that by 2030 half of all global deaths will be from cancer and that our mathematical chance of getting cancer in our lifetime is now approaching 70%.

Drug developments have hit a number of hurdles. Chemotherapeutic drugs primarily target genome stability either directly or through inhibition of cell division. As all cancers show genomic instability these drugs can push these cells into apoptosis or necrosis. Chemotherapeutic drugs, however, demonstrate toxicity to the patient's normal cells and the majority of patients develop resistance to these drugs. Cancer therapies have also been developed, which are directed to subtypes of patients whose cancer is driven by an oncoprotein with a specific drugable mutation. Examples include HER2 overexpression in breast cancer, and EGFR mutations and ALK rearrangements in lung cancer. More recently immune checkpoint inhibitors have been developed that target CTLA4 and the PD1/PDL1 pathway, which are effective against a proportion of solid tumours, but the majority of these inhibitors are only effective against a subset of tumours and, again, in many cases, patients become refractory to them.

There remains a pressing need in the art for new approaches to the treatment or prevention of cancers.

SUMMARY OF THE INVENTION

The present invention is based on the discovery that nucleic acid oligomer compounds of a specified length with a particular backbone chemistry and base composition can bind to cellular proteins involved in DNA repair and/or nuclear export of RNA molecules to the protein synthesis machinery of a cell. Surprisingly, it has also been discovered that these compounds are able to significantly inhibit the proliferation or stimulate the death of tumor cells, including tumor cells associated with prostate, lung, pancreatic, breast, cervical or bone cancer. These discoveries have been reduced to practice in novel compounds, compositions and methods, as described hereafter.

Accordingly, in one aspect, the present invention provides methods for inhibiting proliferation, survival or viability of a tumor cell (e.g., a mammalian tumor cell such as a human tumor cell). These methods generally comprise, consist or consist essentially of introducing into the tumor cell a nucleic acid oligomer that is characterized by:
  a) a backbone comprising phosphorothioate internucleoside linkages;
  b) (i) a purine content of at least about 50%, or (ii) a purine content of at least about 45% with a guanosine-cytosine (GC) content of at least about 50%; and
  c) a length of at least 14 nucleobases and no more than 29 nucleobases, wherein the oligomer binds to one or both of a THO complex subunit 4 (THOC4) protein and a single-stranded DNA-binding protein 1 (SSB1).

Representative purine contents of at least about 45% encompass at least 6 purines in a 14-nucleobase oligomer, at least 7 purines in a 15-nucleobase oligomer, at least 7 purines in a 16-nucleobase oligomer, at least 8 purines in a 17-nucleobase oligomer, at least 8 purines in a 18-nucleobase oligomer, at least 9 purines in a 19-nucleobase oligomer, at least 9 purines in a 20-nucleobase oligomer, at least 9 purines in a 21-nucleobase oligomer, at least 10 purines in a 22-nucleobase oligomer, at least 10 purines in a 23-nucleobase oligomer, at least 11 purines in a 24-nucleobase oligomer, at least 11 purines in a 25-nucleobase oligomer, at least 12 purines in a 26-nucleobase oligomer, at least 12 purines in a 27-nucleobase oligomer, at least 13 purines in a 28-nucleobase oligomer and at least 13 purines in a 29-nucleobase oligomer.

Representative purine contents of at least about 50% encompass at least 7 purines in a 14-nucleobase oligomer, at least 8 purines in a 15-nucleobase oligomer, at least 8 purines in a 16-nucleobase oligomer, at least 9 purines in a 17-nucleobase oligomer, at least 9 purines in a 18-nucleobase oligomer, at least 10 purines in a 19-nucleobase oligomer, at least 10 purines in a 20-nucleobase oligomer, at least 11 purines in a 21-nucleobase oligomer, at least 11 purines in a 22-nucleobase oligomer, at least 12 purines in a 23-nucleobase oligomer, at least 12 purines in a 24-nucleobase oligomer, at least 13 purines in a 25-nucleobase oligomer, at least 13 purines in a 26-nucleobase oligomer, at least 14 purines in a 27-nucleobase oligomer, at least 14 purines in a 28-nucleobase oligomer and at least 15 purines in a 29-nucleobase oligomer.

Representative GC contents of at least about 50% encompass at least 7 G/C in a 14-nucleobase oligomer, at least 8 G/C in a 15-nucleobase oligomer, at least 8 G/C in a 16-nucleobase oligomer, at least 9 G/C in a 17-nucleobase oligomer, at least 9 G/C in a 18-nucleobase oligomer, at least 10 G/C in a 19-nucleobase oligomer, at least 10 G/C in a 20-nucleobase oligomer, at least 11 G/C in a 21-nucleobase oligomer, at least 11 G/C in a 22-nucleobase oligomer, at least 12 G/C in a 23-nucleobase oligomer, at least 12 G/C in a 24-nucleobase oligomer, at least 13 G/C in a 25-nucleobase oligomer, at least 13 G/C in a 26-nucleobase oligomer, at least 14 G/C in a 27-nucleobase oligomer, at least 14 G/C in a 28-nucleobase oligomer and at least 15 G/C in a 29-nucleobase oligomer.

In some embodiments, the oligomer is further characterized in that it blocks translocation of mRNA from the nucleus to the cytoplasm of the tumor cell.

In some embodiments, the oligomer is further characterized in that it is preferentially taken up by the tumor cell, as compared to its uptake by a non-tumor cell.

Suitably, the oligomer is further characterized in that it causes apoptosis or necrosis of the tumor cell. In illustrative examples of this type, the oligomer causes more death of tumor cells of the same type as the tumor cell than of non-tumor cells.

In specific embodiments, the oligomer is further characterized in that it binds to one or both of THOC4 and SSB1 with higher affinity than a control oligomer, suitably under conditions as defined herein.

The introduction of the oligomer into the tumor cell can occur in vivo or in vitro.

Suitably, at least about 70% of the internucleoside linkages of the backbone comprise phosphorothioate internucleoside linkages. In specific embodiments, all internucleoside linkages of the backbone comprise phosphorothioate internucleoside linkages.

In some embodiments, the oligomer is further characterized in that has a melting temperature (Tm) of at least about 45° C.

In some embodiments, the backbone of the oligomer comprises at least one 2'-O-alkyl modified sugar moiety, which is also referred to herein as a "2'-O-alkyl nucleoside" (e.g., 2'-O-methyl nucleoside). In specific examples, the oligomer comprises at least one 2'-O-methyl ribonucleoside. Suitably, at least about 50% of the nucleosides of the oligomer are each a 2'-O-alkyl nucleoside (e.g., 2'-O-methyl nucleoside). In specific embodiments, all nucleosides of the oligomer are each a 2'-O-alkyl nucleoside (e.g., 2'-O-methyl nucleoside).

In some embodiments, the nucleobase sequence over the length of the oligomer lacks substantial complementarity to the transcriptome. Suitably, no more than about 95%, 90%, 85%, 80%, 75%, 70%, 65%, 60%, 55%, 50%, 45%, 40%, 35% 30%, 25%, 20%, 15%, 10%, 5%, 4%, 3%, 2%, 1% of the nucleobases of the oligomer are able to engage in base-pairing with the transcriptome. In illustrative examples of this type, an oligomer of 14 to 29 nucleobases with no more than 95% of its nucleobases able to engage in base-pairing with the transcriptome has at least one non-complementary nucleobase that is unable to base-pair with a nucleobase of a reference nucleobase sequence of the transcriptome. In other illustrative examples, an oligomer of 14 to 29 nucleobases with no more than 90% of its nucleobases able to engage in base-pairing with the transcriptome has at least 1, 2 or 3 non-complementary nucleobases, depending on the length of the oligomer, as for example calculated from TABLE 1 infra, which are unable to base-pair with a nucleobase of a reference nucleobase sequence of the transcriptome.

In some embodiments, the nucleobase sequence over the length of the oligomer lacks substantial complementarity to the genome of a mammal from which the tumor cell is suitably derived. Suitably, no more than about 95%, 90%, 85%, 80%, 75%, 70%, 65%, 60%, 55%, 50%, 45%, 40%, 35% 30%, 25%, 20%, 15%, 10%, 5%, 4%, 3%, 2%, 1% of the nucleobases of the oligomer are able to engage in base-pairing with the genome. In illustrative examples of this type, an oligomer of 14 to 29 nucleobases with no more than 95% of its nucleobases able to engage in base-pairing with the genome has at least one non-complementary nucleobase that is unable to base-pair with a nucleobase of a reference nucleobase sequence of the genome. In other illustrative examples, an oligomer of 14 to 29 nucleobases with no more than 90% of its nucleobases able to engage in base-pairing with the genome has at least 1, 2 or 3 non-complementary nucleobases, depending on the length of the oligomer, as for example calculated from TABLE 1 infra, which are unable to base-pair with a nucleobase of a reference nucleobase sequence of the genome.

In some embodiments, the nucleobase sequence over the length of the oligomer lacks homology to the genome of a mammal from which the tumor cell is suitably derived.

Suitably, the nucleobase sequence over the length of the oligomer has no more than about 95%, 90%, 85%, 80%, 75%, 70%, 65%, 60%, 55%, 50%, 45%, 40%, 35% 30%, 25%, 20%, 15%, 10%, 5%, 4%, 3%, 2%, 1% sequence identity to any equal length of contiguous nucleobases defining a reference nucleobase sequence in the genome. In illustrative examples of this type, an oligomer of 14 to 29 nucleobases with no more than 95% sequence identity to the reference nucleobase sequence in the genome has at least one nucleobase that is not identical to, or does not have the same or equivalent nucleobase-pairing ability as, a nucleobase at a matching position of the reference nucleobase sequence. In other illustrative examples, an oligomer of 14 to 29 nucleobases with no more than 90% sequence identity to the reference nucleobase sequence in the genome has at least 1, 2 or 3 nucleobases, depending on the length of the oligomer, as for example calculated from TABLE 1 infra, which are not identical to, or do not have the same or equivalent nucleobase-pairing ability as, a nucleobase at a matching position of the reference nucleobase sequence.

Oligomer compounds that lack substantial complementarity to the transcriptome or that lack substantial complementarity or homology to the genome are referred to herein as "non-targeting oligomers". In some embodiments, a non-targeting oligomer of the invention comprises a nucleobase sequence selected from any one of SEQ ID NO: 1, 2, 3, 5, 7, 36, 37, 38, 39, 40, 41, 44, 45, 51, 52, 53, 54, 55, 56, 59, 61, 62, 63, 64, 66, 67, 68, 69, 70, 71, 72, 73, 79, 80, 81, 82, 83, 84, 85, 91, 92, 93, 94, 98, 100, 103, 104, 105, 107, 108, 109, 110, 111, 113, 114, 115, 117, 118, 119, 120, 121, 122, 131, 132, 133, 134, 135, 137, 138, 143, 144, 145, 152, 153, 155, 156, 158, 159, 160, 161, 162, 164, 165, 166, 167, 168, 169, 170, 171, 172, 173, 174, 175, 177, 180, 181, 182, 183, 184, 185, 191, 192, 196, 198, 203, 206, 207, 209, 210, 211, 223, 224, 225, 226, 227, 228, 229, 230, 231, 232, 233, 234, 235, 236, 237, 238, 239, 240, 244, 245, 247, 248, 249, 250, 251, 252, 253, 256, 258, 259, 261, 263, 264, 265, 269, 270, 271, 272, 274, 277, 281, 282, 283, 286, 287, 290, 291, 292, 293, 295, 296, 298, 300, 301 and 303.

In other embodiments, the nucleobase sequence over the length of the oligomer has substantial complementarity to an antisense strand of a selected gene. In these embodiments, the nucleobase sequence is suitably complementary to and hybridizes to a target sequence of the selected gene or transcript thereof, including a pre-mRNA or mRNA molecule encoded by the selected gene, under high stringency conditions. Oligomer compounds of this type are also referred to herein as "antisense oligomers". In some embodiments, an antisense oligomer of the invention comprises a nucleobase sequence selected from any one of SEQ ID NO: 6, 10, 12, 14, 15, 16, 17, 21, 22, 23, 24, 25, 27, 28, 29, 31, 32, 33, 34, 35, 101, 278, 279, 280, 284, 285, 288, 289, 297 and 299.

These oligomers have significant activity for inhibiting proliferation, survival or viability of tumor cells. Some of these however, have higher inhibitory activity than others and in preferred embodiments, the oligomer has a nucleobase sequence selected from any one of SEQ ID NO: 1, 2, 3, 5, 6, 10, 12, 14, 15, 16, 17, 21, 22, 23, 24, 25, 28, 32, 31, 34, 35, 36, 38, 39, 41, 44, 52, 56, 53, 54, 59, 61, 63, 64, 66, 67, 68, 69, 70, 71, 72, 73, 79, 80, 81, 82, 83, 84, 91, 92, 93, 98, 100, 103, 104, 107, 109, 110, 111, 113, 114, 117, 118, 119, 120, 121, 122, 131, 132, 133, 134, 135, 143, 144, 145, 153, 155, 156, 158, 159, 160, 161, 162, 164, 165, 167, 168, 169, 170, 171, 172, 180, 181, 182, 191, 192, 203, 224, 225, 226, 227, 229, 230, 233, 234, 235, 236, 238, 239, 240, 245, 247, 251, 252, 253, 258, 259, 261, 263, 264, 269, 271, 272, 274, 285, 286, 287, 288, 289, 290, 291, 292, 293, 295, 296, 297, 298, 299, 300, 301 and 303. In more preferred embodiments, the oligomer has a nucleobase sequence selected from any one of SEQ ID NO: 1, 2, 3, 5, 14, 16, 17, 31, 34, 35, 36, 38, 39, 52, 56, 67, 68, 69, 70, 71, 79, 80, 81, 82, 83, 91, 92, 93, 100, 103, 109, 110, 111, 114, 119, 131, 133, 134, 135, 143, 153, 155, 158, 159, 161, 164, 168, 169, 171, 181, 182, 203, 253, 272, 300, 301 and 303.

The tumor cell can be any cell having neoplastic cell growth and proliferation, whether malignant or benign. It can be pre-cancerous or cancerous. In specific embodiments, the tumor cell is selected from prostate, lung, pancreatic, breast, cervical or bone tumor cells.

The oligomer compound preferentially binds to or has affinity for one or both of THOC4 and hSSB1. The THOC4 and SSB1 proteins are preferably human (i.e., hTHOC4 and hSSB1). In specific embodiments, the oligomer compound preferentially binds to THOC4 (e.g., hTHOC4) with a $K_D$ of about 50 nM or less and/or binds to SSB1 (e.g., hSSB1) with a $K_D$ of about 3 nM or less, suitably in an aqueous solution containing 10 nM Tris-HCl (pH8.0) and 100 mM NaCl at 37° C.

Another aspect of the present invention provides an oligomer as broadly described above and elsewhere herein.

In yet another aspect, the present invention provides a pharmaceutical composition that comprises an oligomer as broadly described above and elsewhere herein, and a pharmaceutically acceptable carrier.

Still another aspect of the present invention provides methods for treating or preventing a cancer in a subject. These methods generally comprise, consist or consist essentially of administering to the subject an effective amount of an oligomer as broadly described above and elsewhere herein.

The cancer may be a solid tumor or bloodborne tumor, including cancers of skin, tissues, organs, bone, cartilage, blood, and vessels. The cancer may be a primary cancer or a metastatic cancer. In specific embodiments, the cancer is selected from prostate, lung, pancreatic, breast, cervical and bone cancer.

In some embodiments, the methods comprise concurrently administering with the oligomer at least one ancillary agent selected from an anti-infective agent (e.g., selected from antibiotics, amebicides, antifungals, antiprotozoals, antimalarials, antituberculotics and antivirals, etc.), a chemotherapeutic agent (e.g., selected from antiproliferative/antineoplastic drugs, cytostatic agents, agents that inhibit cancer cell invasion, inhibitors of growth factor function, anti-angiogenic agents, vascular damaging agents, etc.), and an immunotherapeutic agent (e.g., cytokines, cytokine-expressing cells, antibodies, etc.).

BRIEF DESCRIPTION OF THE DRAWINGS

Binding energy calculated as, $E\_binding = E(complex) - [E(receptor) + E(ligand)]$

DETAILED DESCRIPTION OF THE INVENTION

1. Definitions

Figure 1:
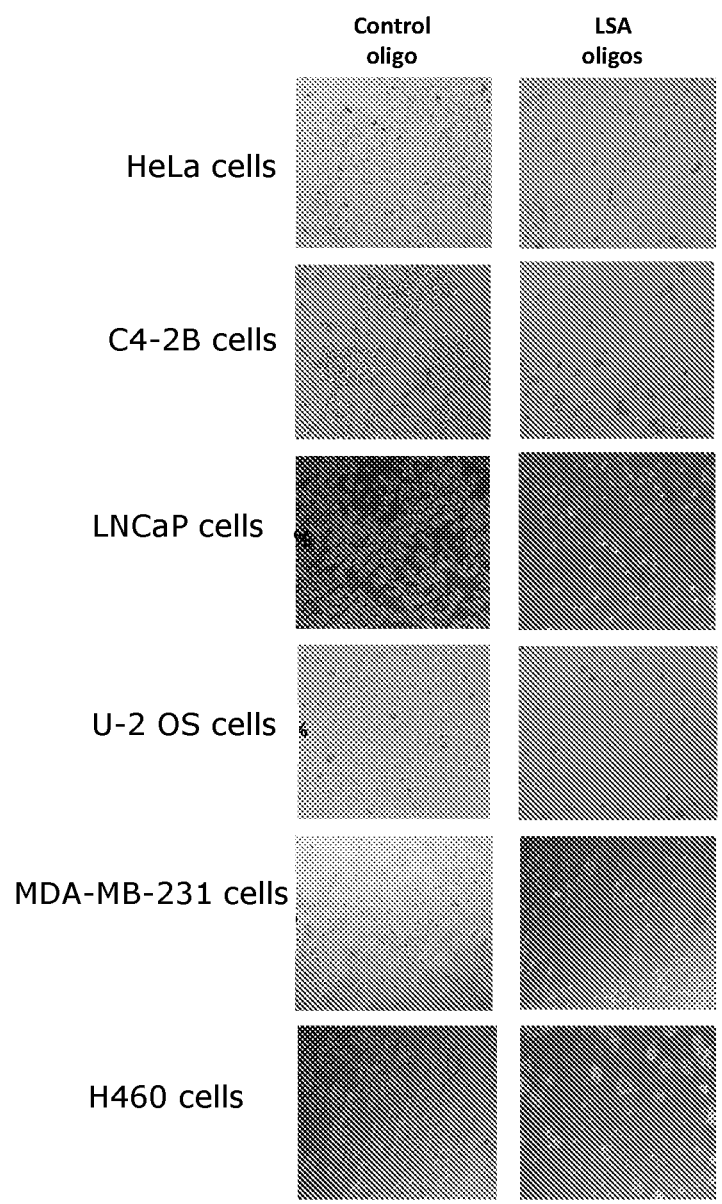
FIG. 1 is a photographic representation showing bright field microscopy images of various cell lines as indicated. The images were taken at 16-36 hr post control oligomer or non-targeting oligomer transfections. Non-targeting oligomer compounds ("LSA") had a significant impact on cell viability as shown by loss of adherence and low confluency compared to control oligonucleotide transfected cells.

Unless defined otherwise, all technical and scientific terms used herein have the same meaning as commonly understood by those of ordinary skill in the art to which the invention belongs. Although any methods and materials similar or equivalent to those described herein can be used in the practice or testing of the present invention, preferred methods and materials are described. For the purposes of the present invention, the following terms are defined below.

The articles "a" and "an" are used herein to refer to one or to more than one (i.e., to at least one) of the grammatical object of the article. By way of example, "an element" means one element or more than one element.

As used herein, "and/or" refers to and encompasses any and all possible combinations of one or more of the associated listed items, as well as the lack of combinations when interpreted in the alternative (or).

Further, the term "about", as used herein when referring to a measurable value such as an amount, dose, time, temperature, activity, level, number, frequency, percentage, dimension, size, amount, weight, position, length and the like, is meant to encompass variations of ±15%, ±10%, ±5%, ±1%, ±0.5%, or even ±0.1% of the specified amount, dose, time, temperature, activity, level, number, frequency, percentage, dimension, size, amount, weight, position, length and the like.

Where a range of values is provided, it is understood that each intervening value, to the tenth of the unit of the lower limit unless the context clearly dictates otherwise, between the upper and lower limit of that range and any other stated or intervening value in that stated range is encompassed within the invention. The upper and lower limits of these smaller ranges may independently be included in the smaller ranges is also encompassed within the invention, subject to any specifically excluded limit in the stated range. Where the stated range includes one or both of the limits, ranges excluding either both of those included limits are also included in the invention.

An agent is "actively taken up by mammalian cells" when the agent can enter the cell by a mechanism other than passive diffusion across the cell membrane. The agent may be transported, for example, by "active transport", referring to transport of agents across a mammalian cell membrane by e.g., an ATP-dependent transport mechanism, or by "facilitated transport", referring to transport of antisense agents across the cell membrane by a transport mechanism that requires binding of the agent to a transport protein, which then facilitates passage of the bound agent across the membrane. For active or facilitated transport, the oligomers of the present invention may be naked or may be formulated in a complexed form, such as an agent having an anionic backbone complexed with cationic lipids or liposomes, which can be taken into cells by an endocytotic mechanism. The oligomer also may be conjugated, e.g., at its 5' or 3' end, to an arginine-rich peptide, e.g., a portion of the HIV TAT protein, or polyarginine, to facilitate transport into the target host cell as described (Moulton et al., *Bioconjug Chem*, 2004, 15(2): 290-299; Nelson et al., *Bioconjug Chem*, 2005, 16(4): 959-966). The compound may also have one or more cationic linkages to enhance antisense activity and/or cellular uptake.

The terms "administration concurrently" or "administering concurrently" or "co-administering" and the like refer to the administration of a single composition containing two or more actives, or the administration of each active as separate compositions and/or delivered by separate routes either contemporaneously or simultaneously or sequentially within a short enough period of time that the effective result is equivalent to that obtained when all such actives are administered as a single composition. By "simultaneously" is meant that the active agents are administered at substantially the same time, and desirably together in the same formulation. By "contemporaneously" it is meant that the active agents are administered closely in time, e.g., one agent is administered within from about one minute to within about one day before or after another. Any contemporaneous time is useful. However, it will often be the case that when not administered simultaneously, the agents will be administered within about one minute to within about eight hours and suitably within less than about one to about four hours. When administered contemporaneously, the agents are suitably administered at the same site on the subject. The term "same site" includes the exact location, but can be within about 0.5 to about 15 centimeters, preferably from within about 0.5 to about 5 centimeters. The term "separately" as used herein means that the agents are administered at an interval, for example at an interval of about a day to several weeks or months. The active agents may be administered in either order. The term "sequentially" as used herein means that the agents are administered in sequence, for example at an interval or intervals of minutes, hours, days or weeks. If appropriate the active agents may be administered in a regular repeating cycle.

As used herein, the term "affinity" refers to the non-random interaction of two molecules. Affinity, or the strength of the interaction, can be expressed quantitatively as a dissociation constant ($K_D$). Binding affinity can be determined using standard techniques. In particular embodiments, the oligomers of this invention have a higher affinity for a target molecule (e.g., THOC4 or SSB1) than a control oligomer and thus preferentially bind the target molecule relative to the control oligomer. For example, oligomer compounds of the invention bind THOC4 (e.g., hTHOC4) with a $K_D$ of about 50 nM or less and/or bind SSB1 (e.g., hSSB1) with a $K_D$ of about 3 nM or less in an aqueous solution containing 10 nM Tris-HCl (pH8.0) and 100 mM NaCl at 37° C.

The term "alkyl", as used herein, refers to a saturated straight or branched hydrocarbon radical containing up to twenty four carbon atoms. Examples of alkyl groups include, but are not limited to, methyl, ethyl, propyl, butyl, isopropyl, n-hexyl, octyl, decyl, dodecyl and the like. Alkyl groups typically include from 1 to about 6 carbon atoms, more typically from 1 to about 3 carbon atoms with from 1 to about 2 carbon atoms being more preferred. Alkyl groups as used herein may optionally include one or more further substitutent groups.

The term "ancillary agent" includes a compound that induces a desired pharmacological and/or physiological effect. The term also encompass pharmaceutically acceptable and pharmacologically active ingredients of those compounds specifically mentioned herein including but not limited to salts, esters, amides, prodrugs, active metabolites, analogs and the like. When the above term is used, then it is to be understood that this includes the active agent per se as well as pharmaceutically acceptable, pharmacologically active salts, esters, amides, prodrugs, metabolites, analogs, etc. The term "ancillary agent" is not to be construed narrowly but extends to small molecules, proteinaceous molecules such as peptides, polypeptides and proteins as well as compositions comprising them and genetic molecules such as RNA, DNA and mimetics and chemical analogs thereof as well as cellular agents. The term "ancillary agent" includes a cell that is capable of producing and secreting a polypeptide as well as a polynucleotide comprising a nucleotide sequence that encodes that polypeptide. For example, the cell can be tumor cell into which a construct has been introduced, which expresses an immunostimulatory molecule such as B7.1 or 4-1BBL. Thus, the term "ancillary agent" extends to nucleic acid constructs including vectors such as viral or non-viral vectors, expression vectors and plasmids for expression in and secretion in a range of cells.

The term "antisense" refers to a nucleotide sequence whose sequence of nucleotide residues is in reverse 5' to 3' orientation in relation to the sequence of deoxynucleotide residues in a sense strand of a nucleic acid (e.g., DNA or RNA) duplex. A "sense strand" of a DNA duplex refers to a strand in a DNA duplex which is transcribed by a cell in its natural state into a "sense mRNA." Thus an "antisense" sequence is typically substantially complementary to the coding strand in a DNA duplex and has homology to the non-coding strand in a DNA duplex.

The terms "antisense oligomer" and "antisense compound" are used interchangeably herein to refer to a compound having a targeting sequence of nucleobases and a subunit-to-subunit backbone that allows the antisense oligomer to hybridize to a target nucleic acid sequence by base-pairing, including Watson-Crick base-pairing, to form an RNA:oligomer or DNA:oligomer heteroduplex within the target nucleic acid sequence. The antisense oligomer typically includes a sequence of purine and pyrimidine heterocyclic bases, supported by a backbone, which are effective to hydrogen-bond to corresponding, contiguous bases in a target nucleic acid sequence. The backbone is typically composed of subunit backbone moieties supporting the purine and pyrimidine heterocyclic bases at positions that allow such hydrogen bonding. These backbone moieties are cyclic moieties of 5 to 7 atoms in length, linked together by phosphorous-containing linkages one to three atoms long. Antisense oligomers typically interfere with the synthesis of a gene expression product including nucleic acid expression products such as mRNA and miRNA and polypeptides. In general, targeting sequence of an antisense oligomer binds to a target sequence corresponding to the "sense" strand of a target gene (e.g., polynucleotides such as DNA, mRNA (including pre-mRNA)) molecules. Antisense oligomers can bind to any region of a target gene or nucleic acid expression product, including e.g., introns, exons, 5', or 3' untranslated regions. For example, antisense oligomers that work as steric blockers preferentially bind within a splice junction, 5' untranslated region, or the start region of a nucleic acid target molecule. Antisense oligomers that work by activating RNase H preferably bind within an intron, an exon, the 5' untranslated region, or the 3' untranslated region of a target nucleic acid.

The terms "cap structure" or "terminal cap moiety" as used herein, refer to chemical modifications, which can be attached to one or both of the termini of an oligomeric compound.

As used herein, "complementary" and "complementarity" in reference to oligomeric compounds (e.g., linked nucleosides, oligonucleotides, or nucleic acids) means the capacity of such oligomeric compounds or regions thereof to hybridize to a reference nucleic acid sequence through nucleobase complementarity. As used herein, "nucleobase complementarity" or "complementarity" when in reference to nucleobases means a nucleobase that is capable of base-pairing with another nucleobase, typically by Watson-Crick base-pairing. For example, if a nucleobase at a certain position of an oligomer compound is capable of hydrogen bonding with a nucleobase at a certain position of a target nucleic acid, then the position of hydrogen bonding between the oligomer compound and the target nucleic acid is considered to be complementary at that nucleobase pair. Thus, a modified nucleobase may maintain the ability to pair with a counterpart nucleobase and thus, are still capable of nucleobase-pairing or nucleobase complementarity. By contrast, "non-complementary" or "mismatch" nucleobases refer to a pair of nucleobases that do not form hydrogen bonds with one another, or are otherwise "unable to base pair". The terms "complementary" or "complementarity", also refer to the natural binding of nucleic acid under permissive salt and temperature conditions by base-pairing. Complementarity between two single stranded molecules (also referred to herein as "nucleobase polymers") may be "partial", in which only some of the nucleobases base pair, or it may be "complete" when total complementarity exists between the single stranded molecules either along the full length of the molecules or along a portion or region of the single stranded molecules. The degree of complementarity between nucleic acid strands has significant effects on the efficiency and strength of hybridization between nucleic acid strands. The term "complementary" includes within its scope nucleic acid sequences that are "fully complementary", "substantially complementary" or "partially complementary". As used herein, the term "fully complementary" indicates that 100% of the nucleobases in a particular nucleobase oligomer or polymer are able to engage in base-pairing with another nucleobase oligomer or polymer. As used herein, the term "substantially complementary", or its grammatical equivalents, indicates that greater than 95%, 96%, 97%, 98% or 99% of the nucleobases in a particular nucleobase oligomer or polymer are able to engage in base-pairing with another nucleobase oligomer or polymer. This term can also mean that two nucleic acid sequences can hybridize under high stringency conditions, as defined for example herein. As used herein, the term "partially complementary", or its grammatical equivalents, indicates that no more than about 95%, 90%, 85%, 80%, 75%, 70%, 65%, 60%, 55%, 50%, 45%, 40%, 35% 30%, 25%, 20%, 15%, 10%, 5%, 4%, 3%, 2%, 1% of the nucleobases in a particular nucleobase oligomer or polymer are able to engage in base-pairing with another nucleobase oligomer or polymer. This term can also mean that two nucleic acid sequences are unable to hybridize under high stringency conditions, as defined for example herein, but are able to hybridize or not under low or medium stringency conditions, as defined for example herein.

Throughout this specification, unless the context requires otherwise, the words "comprise," "comprises" and "comprising" will be understood to imply the inclusion of a stated step or element or group of steps or elements but not the exclusion of any other step or element or group of steps or elements. Thus, use of the term "comprising" and the like indicates that the listed elements are required or mandatory, but that other elements are optional and may or may not be present. By "consisting of" is meant including, and limited to, whatever follows the phrase "consisting of". Thus, the phrase "consisting of" indicates that the listed elements are required or mandatory, and that no other elements may be present. By "consisting essentially of" is meant including any elements listed after the phrase, and limited to other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they affect the activity or action of the listed elements.

As used herein, the term "contiguous" in the context of a nucleic acid sequence means that the sequence is a single sequence, uninterrupted by any intervening sequence or sequences.

By "corresponds to" or "corresponding to" is meant a nucleic acid sequence that displays substantial sequence identity to a reference nucleic acid sequence (e.g., at least about 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 97, 88, 89, 90, 91, 92, 93, 94, 95, 96, 97, 98, 99% or even up to 100% sequence identity to all or a portion of the reference nucleic acid sequence).

By "effective amount", in the context of treating or preventing a condition is meant the administration of an amount of an agent or composition to an individual in need of such treatment or prophylaxis, either in a single dose or as part of a series, that is effective for the prevention of incurring a symptom, holding in check such symptoms, and/or treating existing symptoms, of that condition. The effective amount will vary depending upon the health and physical condition of the individual to be treated, the taxonomic group of individual to be treated, the formulation of the composition, the assessment of the medical situation, and other relevant factors. It is expected that the amount will fall in a relatively broad range that can be determined through routine trials.

The term "expression" refers the biosynthesis of a gene product. For example, in the case of a coding sequence, expression involves transcription of the coding sequence into mRNA and translation of mRNA into one or more polypeptides. Conversely, expression of a non-coding sequence involves transcription of the non-coding sequence into a transcript only.

As used herein, the term "gapmer" refers to a chimeric oligomeric compound comprising a central region (a "gap") and a region on either side of the central region (the "wings"), wherein the gap comprises at least one modification that is different from that of each wing. Such modifications include nucleobase, monomeric linkage, and sugar modifications as well as the absence of modification (unmodified). Thus, in certain embodiments, the nucleoside linkages in each of the wings are different than the nucleoside linkages in the gap. In certain embodiments, nucleotides in the gap are unmodified and nucleotides in the wings are modified. In certain embodiments, the modification(s) in each wing are the same. In certain embodiments, the modification(s) in one wing are different from the modification(s) in the other wing.

As used herein, the term "gene" refers to a nucleic acid molecule capable of being used to produce mRNA, antisense RNA, siRNA, shRNA, miRNA, and the like. Genes may or may not be capable of being used to produce a functional protein. Genes can include both coding and non-coding regions (e.g., introns, regulatory elements including promoters, enhancers, termination sequences and 5' and 3' untranslated regions). A gene may be "isolated" by which is meant a nucleic acid molecule that is substantially or essentially free from components normally found in association with the nucleic acid molecule in its natural state. Such components include other cellular material, culture medium from recombinant production, and/or various chemicals used in chemically synthesizing the nucleic acid molecule. Reference to a "gene" also includes within its scope reference to genes having a contiguous sequence, thus defining contiguous nucleic acid entities, as defined herein, or a non-contiguous sequence thus defining a non-contiguous nucleic acid entity as defined herein. In certain embodiments, the term "gene" includes within its scope the open reading frame encoding specific polypeptides, introns, and adjacent 5' and 3' non-coding nucleotide sequences involved in the regulation of expression. In this regard, the gene may further comprise control sequences such as promoters, enhancers, termination and/or polyadenylation signals that are naturally associated with a given gene, or heterologous control sequences. The gene sequences may be cDNA or genomic DNA or a fragment thereof. The gene may be introduced into an appropriate vector for extrachromosomal maintenance or for introduction into a host.

"Genome" as used herein refers to the entirety of an organism's hereditary information, represented by genes and non-coding sequences of DNA, either chromosomal or non-chromosomal genetic elements such as, linear polynucleotides, e.g., including the gene(s) to be assembled and/or recombined. Thus, the term "genome" is intended to include the entire DNA complement of an organism, including the nuclear DNA component, chromosomal or extrachromosomal DNA, as well as the cytoplasmic domain (e.g., mitochondrial DNA).

As used herein the term "heterocyclic base moiety" refers to nucleobases and modified or substitute nucleobases used to form nucleosides encompassed by the present invention. The term "heterocyclic base moiety" includes unmodified nucleobases such as the native purine bases adenine (A) and guanine (G), and the pyrimidine bases thymine (T), cytosine (C) and uracil (U). The term is also intended to include all manner of modified or substitute nucleobases including but not limited to synthetic and natural nucleobases such as xanthine, hypoxanthine, 2-aminopyridine and 2-pyridone, 5-methylcytosine (5-me-C), 5-hydroxymethylenyl cytosine, 2-amino and 2-fluoroadenine, 2-propyl and other alkyl derivatives of adenine and guanine, 2-thio cytosine, uracil, thymine, 3-deaza guanine and adenine, 4-thiouracil, 5-uracil (pseudouracil), 5-propynyl (—C≡C—CH$_3$) uracil and cytosine and other alkynyl derivatives of pyrimidine bases, 5-halo particularly 5-bromo, 5-trifluoromethyl and other 5-substituted uracils and cytosines, 6-methyl and other alkyl derivatives of adenine and guanine, 6-azo uracil, cytosine and thymine, 7-methyl adenine and guanine, 7-deaza adenine and guanine, 8-halo, 8-amino, 8-aza, 8-thio, 8-thioalkyl, 8-hydroxyl and other 8-substituted adenines and guanines, universal bases, hydrophobic bases, promiscuous bases, size-expanded bases, and fluorinated bases as defined herein. Further modified nucleobases include tricyclic pyrimidines such as phenoxazine cytidine (1H-pyrimido[5,4-b][1,4]benzoxazin-2(3H)-one) and phenothiazine cytidine (1H-pyrimido[5,4-b][1,4]benzothiazin-2(3H)-one).

As used herein the terms "homolog", "homolog" or "homologous" refer to the level of similarity between two or more nucleic acid sequences in terms of percent of sequence identity. Generally, homologs, homologous sequences or sequences with homology refer to nucleic acid sequences that exhibit greater than 95%, 96%, 97%, 98%, 99% sequence identity to one another. Alternatively, or in addition, homologs, homologous sequences or sequences with homology refer to nucleic acid sequences that hybridize under high stringency conditions, as defined for example herein, to one another. By contrast, the terms "non-homologous", "non-homologous sequences" or "sequences that lack homology" and the like refer to nucleic acid sequences that exhibit no more than 95%, 90%, 85%, 80%, 75% 70%, 65%, 60%, 55%, 50%, 45%, 40%, 35% 30%, 25%, 20%, 15%, 10%, 5%, 4%, 3%, 2%, 1% sequence identity to one another. Alternatively, or in addition, non-homologous", "non-homologous sequences" or "sequences that lack homology" and the like refer to nucleic acid sequences that do not hybridize under high stringency conditions, as defined for example herein, to one another but are able to hybridize or not under medium or low stringency conditions to one another.

"Hybridization" is used herein to denote the pairing of complementary nucleotide sequences to produce a DNA-DNA hybrid or a DNA-RNA hybrid. Complementary nucleobase sequences are those sequences that are related by the base-pairing rules. In DNA, A pairs with T and C pairs with G. In RNA U pairs with A and C pairs with G. In this regard, the terms "match" and "mismatch" as used herein refer to the hybridization potential of paired nucleotides in complementary nucleic acid strands. Matched nucleotides hybridize efficiently, such as the classical A-T and G-C base pair mentioned above. Mismatches are other combinations of nucleotides that do not hybridize efficiently. In the present invention, the preferred mechanism of pairing involves hydrogen bonding, which may be Watson-Crick, Hoogsteen or reversed Hoogsteen hydrogen bonding, between complementary nucleoside or nucleotide bases (nucleobases) of the strands of oligomeric compounds. For example, adenine and thymine are complementary nucleobases which pair through the formation of hydrogen bonds. Hybridization can occur under varying circumstances as known to those of skill in the art.

As used herein, the term "in vitro" refers to events that occur in an artificial environment, e.g., in a test tube or reaction vessel, in cell culture, in a Petri dish, etc., rather than within an organism (e.g., animal, plant, or microbe).

As used herein, the term "in vivo" refers to events that occur within an organism (e.g., animal, plant, or microbe or cell or tissue thereof).

As used herein "internucleoside linkage" refers to a covalent linkage between adjacent nucleosides. The internucleoside linkages constitute the backbone of a nucleic acid molecule, including the oligomers of the present invention.

"Introducing" in the context of a host cell including a mammalian cell, mammalian part, mammalian organ, or whole mammal means contacting a nucleic acid molecule (e.g., an oligonucleotide as described herein) with the mammalian cell, mammalian part, mammalian organ, or whole mammal in such a manner that the nucleic acid molecule gains access to the interior of the mammalian cell, mammalian part, mammalian organ, or whole mammal.

The term "modified sugar", as used herein, refers to a substitution or change from a natural sugar and encompasses modifications of native ribofuranose and deoxyribofuranose sugars used in the nucleosides and oligomeric compounds of the invention. Modified sugars comprise nucleosides where the heterocyclic base moiety or modified heterocyclic base moiety is usually maintained for hybridization with an appropriate target nucleic acid. Such "modified sugars" are often desired over the naturally occurring forms because of advantageous properties they can impart to an oligomeric compound such as, for example, enhanced cellular uptake, enhanced affinity for nucleic acid target and increased stability to nuclease degradation. The term "modified sugar" is intended to include all manner of modifications known in the art including without limitation modifications to ring atoms and/or addition of substituent groups.

As used herein, the term "nucleobase" refers to the base portion of a nucleoside. A nucleobase is typically a heterocyclic moiety and may comprise any atom or group of atoms capable of hydrogen bonding to a base of another nucleic acid. The term "nucleobase" encompasses natural nucleobases and modified nucleobases. Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications may impart nuclease stability, binding affinity or some other beneficial biological property to antisense compounds. Modified nucleobases include synthetic and natural nucleobases such as, for example, 5-methylcytosine (5-me-C). Certain nucleobase substitutions, including 5-methylcytosine substitutions, are particularly useful for increasing the binding affinity of an antisense compound for a target nucleic acid. For example, 5-methylcytosine substitutions have been shown to increase nucleic acid duplex stability by 0.6-1.2.degree. C. (Sanghvi, Y. S., Crooke, S. T. and Lebleu, B., eds., Antisense Research and Applications, CRC Press, Boca Raton, 1993, pp. 276-278). Additional unmodified nucleobases include 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH$_3$) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine. Heterocyclic base moieties may also include those in which the purine or pyrimidine base is replaced with other heterocycles, for example 7-deazaadenine, 7-deazaguanosine, 2-aminopyridine and 2-pyridone. Nucleobases that are particularly useful for increasing the binding affinity of antisense compounds include 5-substituted pyrimidines, 6-azapyrimidines and N-2, N-6 and 0-6 substituted purines, including 2 aminopropyladenine, 5-propynyluracil and 5-propynylcytosine.

The term "nucleoside", as used herein, refers to a base-sugar combination. The base portion of the nucleoside is normally a heterocyclic base moiety. The two most common classes of such heterocyclic nucleobases are purines and pyrimidines. "Nucleotides" are nucleosides that further include a phosphate group covalently linked to the sugar portion of the nucleoside. For those nucleosides that include a pentofuranosyl sugar, the phosphate group can be linked to either the 2', 3' or 5' hydroxyl moiety of the sugar. Within the oligonucleotide structure, the phosphate groups are commonly referred to as forming the internucleoside linkages of the oligonucleotide, or in conjunction with the sugar ring, the backbone of the oligonucleotide. In forming oligonucleotides, the phosphate groups covalently link adjacent nucleosides to one another to form a linear polymeric compound. The normal internucleoside linkage of RNA and DNA is a 3' to 5' phosphodiester linkage. In the context of this invention, the term "oligonucleoside" refers to a sequence of nucleosides that are joined by internucleoside linkages that do not have phosphorus atoms.

The term "OB-fold protein" refers to any polypeptide which comprises or consists of a domain having OB-fold topology, as described for example by (Murzin, 1993, *Embo J* 12: 861-86) and (Arcus, 2002, *Curr Opin Struct Biol* 12: 794-801), and facilitates binding to ssDNA. This topology corresponds to an architecture which comprises a five-stranded (β-barrel capped at one end by an amphiphilic α-helix. Referring to the CATH protein structure classification (Pearl et al., 2003, *Nucleic Acids Res* 31: 452-455), the OB-fold topology corresponds to the 2.40.50 fold family (CATH database version 3.0.0: Released May 2006). Such an OB-fold protein can be either a native protein (i.e., an isolated, purified or recombinant protein having the same sequence as a natural protein), or an engineered protein (like, for example, a fragment of a native protein, or a fusion protein comprising an OB-fold domain from a first protein, and another moiety from another protein). Non-limitative examples of OB-fold proteins which can be used according to the invention encompass single stranded DNA binding proteins (SSBs) including simple SSBs, which contain one OB-fold per polypeptide, and higher order SSBs, which contain multiple OB-folds (which may be on different polypeptides). Representative simple SSBs include single-stranded DNA binding proteins 1 and 2 (e.g., hSSB1 and 2) and the mitochondrial SSB (mtSSB), while higher order SSBs are represented by heterotrimeric replication protein A (RPA). In addition, other proteins have also adopted the ssDNA-binding-OB-fold structure within their polypeptides and may be considered members of the SSB family. For instance the serine/threonine kinase receptor associated protein (Strap) structurally contains one DNA binding OB fold as do the simple SSBs, while the TPP1—protection of telomeres 1 (POT1) breast cancer 2, early onset (BRCA2) and the CST complex form complexes reminiscent of higher order SSBs. Numerous OB-fold proteins are known in the art, illustrative examples of which are disclosed in Ashton et al. (2013, *BMC Molecular Biology* 14: 9) and Flynn et al. (2010, *Crit Rev Biochem Mol Biol.* 45(4): 266-275).

The term "oligonucleotide" as used herein refers to a polymer to an oligomer or polymer of ribonucleic acid (RNA) or deoxyribonucleic acid (DNA) composed of naturally occurring nucleobases, sugars and phosphodiester internucleoside linkages.

The terms "oligomer", "oligomer compound" and "oligomeric compound" are used interchangeably herein to refer to a plurality of naturally occurring and/or non-naturally occurring nucleosides, joined together in a specific sequence, to form a polymeric structure. Included in the terms "oligomer" and "oligomeric compound" are oligonucleotides, oligonucleotide analogs, oligonucleotide mimetics, oligonucleosides and chimeric combinations of these, and are thus intended to be broader than the term "oligonucleotide", including all oligomers having all manner of modifications including but not limited to those known in the art. Oligomeric compounds are typically structurally distinguishable from, yet functionally interchangeable with, naturally-occurring or synthetic wild-type oligonucleotides. Thus, oligomeric compounds include all such structures that function effectively to mimic the structure and/or function of a desired RNA or DNA strand, for example, by hybridizing to a target. Such non-naturally occurring oligonucleotides are often desired over the naturally occurring forms because they often have enhanced properties, such as for example, enhanced cellular uptake, enhanced affinity for nucleic acid target and increased stability in the presence of nucleases.

The terms "patient", "subject", "host" or "individual" used interchangeably herein, refer to any subject, particularly a vertebrate subject, and even more particularly a mammalian subject, for whom therapy or prophylaxis is desired. Suitable vertebrate animals that fall within the scope of the invention include, but are not restricted to, any member of the subphylum Chordata including primates (e.g., humans, monkeys and apes, and includes species of monkeys such from the genus *Macaca* (e.g., cynomologus monkeys such as *Macaca fascicularis*, and/or rhesus monkeys (*Macaca mulatta*)) and baboon (*Papio ursinus*), as well as marmosets (species from the genus *Callithrix*), squirrel monkeys (species from the genus *Saimiri*) and tamarins (species from the genus *Saguinus*), as well as species of apes such as chimpanzees (Pan troglodytes)), rodents (e.g., mice rats, guinea pigs), lagomorphs (e.g., rabbits, hares), bovines (e.g., cattle), ovines (e.g., sheep), caprines (e.g., goats), porcines (e.g., pigs), equines (e.g., horses), canines (e.g., dogs), felines (e.g., cats), avians (e.g., chickens, turkeys, ducks, geese, companion birds such as canaries, budgerigars etc.), marine mammals (e.g., dolphins, whales), reptiles (snakes, frogs, lizards etc.), and fish. In specific embodiments, the subject is a primate such as a human. However, it will be understood that the aforementioned terms do not imply that symptoms are present.

Percentages are used herein to refer to an approximate proportion of nucleobases or internucleoside linkages over the length of an oligomer, which have a certain characteristic or feature. The number of nucleobases with these features or characteristics can be easily calculated from these percentages based on the number of nucleobases in the oligomer. Representative calculations are provided in TABLE 1 below, in which the listed values are rounded up or down to the nearest integer.

TABLE 1

| | Percentage of nucleobases or internucleoside linkages with features | | | | | | | | | | |
|---|---|---|---|---|---|---|---|---|---|---|---|
| Oligo Length | 45% | 50% | 55% | 60% | 65% | 70% | 75% | 80% | 85% | 90% | 95% |
| | Calculated number of nucleobases or internucleoside linkages with features | | | | | | | | | | |
| 14 | 6 | 7 | 8 | 8 | 9 | 10 | 11 | 11 | 12 | 13 | 13 |
| 15 | 7 | 8 | 8 | 9 | 10 | 11 | 11 | 12 | 13 | 14 | 14 |
| 16 | 7 | 8 | 9 | 10 | 10 | 11 | 12 | 13 | 14 | 14 | 15 |
| 17 | 8 | 9 | 9 | 10 | 11 | 12 | 13 | 14 | 14 | 15 | 16 |
| 18 | 8 | 9 | 10 | 11 | 12 | 13 | 14 | 14 | 15 | 16 | 17 |
| 19 | 9 | 10 | 10 | 11 | 12 | 13 | 14 | 15 | 16 | 17 | 18 |
| 20 | 9 | 10 | 11 | 12 | 13 | 14 | 15 | 16 | 17 | 18 | 19 |
| 21 | 9 | 11 | 12 | 13 | 14 | 15 | 16 | 17 | 18 | 19 | 20 |
| 22 | 10 | 11 | 12 | 13 | 14 | 15 | 17 | 18 | 19 | 20 | 21 |
| 23 | 10 | 12 | 13 | 14 | 15 | 16 | 17 | 18 | 20 | 21 | 22 |
| 24 | 11 | 12 | 13 | 14 | 16 | 17 | 18 | 19 | 20 | 22 | 23 |
| 25 | 11 | 13 | 14 | 15 | 16 | 18 | 19 | 20 | 21 | 23 | 24 |
| 26 | 12 | 13 | 14 | 16 | 17 | 18 | 20 | 21 | 22 | 23 | 25 |
| 27 | 12 | 14 | 15 | 16 | 18 | 19 | 20 | 22 | 23 | 24 | 26 |
| 28 | 13 | 14 | 15 | 17 | 18 | 20 | 21 | 22 | 24 | 25 | 27 |
| 29 | 13 | 15 | 16 | 17 | 19 | 20 | 22 | 23 | 25 | 26 | 28 |

By "pharmaceutically acceptable carrier" is meant a pharmaceutical vehicle comprised of a material that is not biologically or otherwise undesirable, i.e., the material may be administered to a subject along with the selected active agent without causing any or a substantial adverse reaction. Generally, a pharmaceutically acceptable carrier is substantially nontoxic and non-inflammatory in subjects. Carriers may include excipients and other additives such as diluents, detergents, coloring agents, wetting or emulsifying agents, pH buffering agents, preservatives, transfection agents and the like. In some embodiments, pharmaceutically acceptable carriers are vehicles capable of suspending and/or dissolving active agents. Carriers may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary carriers include, but are not limited to: butylated hydroxytoluene (BHT), calcium carbonate, calcium phosphate (dibasic), calcium stearate, Croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C and xylitol.

The terms "polynucleotide," "genetic material," "genetic forms," "nucleic acids" and "nucleotide sequence" include RNA, cDNA, genomic DNA, synthetic forms and mixed polymers, single stranded, double stranded, both sense and antisense strands, and may be chemically or biochemically modified or may contain non-natural or derivatized nucleobases, as will be readily appreciated by those skilled in the art.

The term "preferentially" in the context of uptake of an oligomer by a tumor cell means that the oligomer is taken up by the tumor cell at a higher level than by a non-tumor or normal cell under the same conditions, which can be in vivo or in vitro. Alternatively, the term "preferentially" in the context of binding of an oligomer to a target molecule means that the oligomer binds to the target molecule with greater affinity than it binds to an unrelated or non-target molecule, or that the target molecule binds to the oligomer with greater affinity than a control oligomer, under the same conditions, which can be in vivo or in vitro. Oligomer uptake can be at least 1-fold greater, at least 2-fold greater, at least 3-fold greater, at least 4-fold greater, at least 5-fold greater, at least 6-fold greater, at least 7-fold greater, at least 8-fold greater, at least 9-fold greater, 10-fold greater, at least 20-fold greater, at least 30-fold greater, at least 40-fold greater, at least 50-fold greater, at least 60-fold greater, at least 70-fold greater, at least 80-fold greater, at least 90-fold greater, at least 100-fold greater, or at least 1000-fold greater by a tumor cell than by a non-tumor or normal cell. Likewise, oligomer affinity can be at least 1-fold greater, at least 2-fold greater, at least 3-fold greater, at least 4-fold greater, at least 5-fold greater, at least 6-fold greater, at least 7-fold greater, at least 8-fold greater, at least 9-fold greater, 10-fold greater, at least 20-fold greater, at least 30-fold greater, at least 40-fold greater, at least 50-fold greater, at least 60-fold greater, at least 70-fold greater, at least 80-fold greater, at least 90-fold greater, at least 100-fold greater, or at least 1000-fold greater to a target molecule than the affinity of the oligomer for an unrelated or non-target molecule. Alternatively, target molecule affinity can be at least 1-fold greater, at least 2-fold greater, at least 3-fold greater, at least 4-fold greater, at least 5-fold greater, at least 6-fold greater, at least 7-fold greater, at least 8-fold greater, at least 9-fold greater, 10-fold greater, at least 20-fold greater, at least 30-fold greater, at least 40-fold greater, at least 50-fold greater, at least 60-fold greater, at least 70-fold greater, at least 80-fold greater, at least 90-fold greater, at least 100-fold greater, or at least 1000-fold greater to an oligomer than the affinity of the target molecule for a control oligomer. General techniques for measuring oligomer uptake or affinity are known to the skilled person. The measured uptake or affinity and other oligomer-binding parameters can vary if measured under different conditions, e.g., salt concentration, pH, etc. Thus measurement of uptake or affinity and other oligomer-binding parameters, e.g., $K_D$, $IC_{50}$, are preferably made with standardized solutions of oligomer and target cells or molecules, and a standardized buffer.

As used herein, the terms "prevent", "prevented", or "preventing", refer to a prophylactic treatment which increases the resistance of a subject to developing the disease or condition or, in other words, decreases the likelihood that the subject will develop the disease or condition as well as a treatment after the disease or condition has begun in order to reduce or eliminate it altogether or prevent it from becoming worse. These terms also include within their scope preventing the disease or condition from occurring in a subject which may be predisposed to the disease or condition but has not yet been diagnosed as having it.

The terms "reduce", "inhibit", "decrease," and grammatical equivalents when used in reference to the level of a substance and/or phenomenon in a first sample relative to a second sample, mean that the quantity of substance and/or phenomenon in the first sample is lower than in the second sample by any amount that is statistically significant using any art-accepted statistical method of analysis. In one embodiment, the reduction may be determined subjectively, for example when a patient refers to their subjective perception of disease symptoms, such as pain, fatigue, etc. In another embodiment, the reduction may be determined objectively, for example when the number of tumor cells in a sample from a patient is lower than in an earlier sample from the patient. In another embodiment, the quantity of substance and/or phenomenon in the first sample is at least 10% lower than the quantity of the same substance and/or phenomenon in a second sample. In another embodiment, the quantity of the substance and/or phenomenon in the first sample is at least 25% lower than the quantity of the same substance and/or phenomenon in a second sample. In yet another embodiment, the quantity of the substance and/or phenomenon in the first sample is at least 50% lower than the quantity of the same substance and/or phenomenon in a second sample. In a further embodiment, the quantity of the substance and/or phenomenon in the first sample is at least 75% lower than the quantity of the same substance and/or phenomenon in a second sample. In yet another embodiment, the quantity of the substance and/or phenomenon in the first sample is at least 90% lower than the quantity of the same substance and/or phenomenon in a second sample. Alternatively, a difference may be expressed as an "n-fold" difference.

The term "sequence identity" as used herein refers to the extent that sequences are identical or has the same nucleobase-pairing ability on a nucleobase-by-nucleobase basis over a window of comparison. Thus, a "percentage of sequence identity" or "percent identity" is calculated by comparing two optimally aligned sequences over the window of comparison, determining the number of positions at which the identical nucleobase or nucleobase with equivalent base-pairing ability occurs in both sequences to yield the number of matched positions, dividing the number of matched positions by the total number of positions in the window of comparison (i.e., the window size), and multiplying the result by 100 to yield the percentage of sequence identity. For the purposes of the present invention, "sequence identity" will be understood to mean the "match percentage" calculated by an appropriate method. For example, sequence identity analysis may be carried out using the DNASIS computer program (Version 2.5 for windows; available from Hitachi Software engineering Co., Ltd., South San Francisco, Calif., USA) using standard defaults as used in the reference manual accompanying the software. Thus, oligomer compounds of the present invention, or a portion thereof, may have a defined percent identity to a reference sequence. As used herein, an oligomer nucleobase sequence is identical to a reference nucleobase sequence if it has the same nucleobase-pairing ability. For example, an oligomer that contains uracil in place of thymidine in a reference sequence would be considered identical as they both pair with adenine. Similarly, an oligomer containing a modified guanine nucleobase such as 6-methyl guanine in place of guanine in the reference sequence would be considered identical as they both pair with cytosine. The identity may be over the entire length of the oligomeric compound, or in a portion of the oligomer compound (e.g., nucleobases 1-20 of a 27-mer may be compared to a 20-mer to determine percent identity of the oligomeric compound to the reference sequence). Any non-identical bases may be adjacent to each other, dispersed through out the oligomer, or both. For example, a 16-mer having the same sequence as nucleobases 2-17 of a 20-mer is 80% identical to the 20-mer. Alternatively, a 20-mer containing four nucleobases not identical to the 20-mer is also 80% identical to the 20-mer. A 14-mer having the same sequence as nucleobases 1-14 of an 18-mer is 78% identical to the 18-mer. Such calculations are well within the ability of those skilled in the art.

Terms used to describe sequence relationships between two or more polynucleotides or polypeptides include "reference sequence", "comparison window", "sequence identity", "percentage of sequence identity" and "substantial identity". A "reference sequence" is at least 14 and up to 29 (e.g., 14, 15, 16, 17, 18, 19, 20, 21, 22, 23, 24, 25, 26, 27, 28, 29) nucleobases. Because two nucleic acids may each comprise (1) a sequence that is similar between the two nucleic acids, and (2) a sequence that is divergent between the two nucleic acids, sequence comparisons between two (or more) nucleic acids are typically performed by comparing sequences of the two nucleic acids over a "comparison window" to identify and compare local regions of sequence similarity. A "comparison window" refers to a conceptual segment of at least 14 and up to 29 (e.g., 14, 15, 16, 17, 18, 19, 20, 21, 22, 23, 24, 25, 26, 27, 28, 29) contiguous nucleobase positions, in which a sequence is compared to a reference sequence of the same number of contiguous nucleobase positions after the two sequences are optimally aligned. The comparison window may comprise additions or deletions (i.e., gaps) of about 20% or less as compared to the reference sequence (which does not comprise additions or deletions) for optimal alignment of the two sequences. Optimal alignment of sequences for aligning a comparison window may be conducted by computerized implementations of algorithms (GAP, BESTFIT, FASTA, and TFASTA in the Wisconsin Genetics Software Package Release 7.0, Genetics Computer Group, 575 Science Drive Madison, Wis., USA) or by inspection and the best alignment (i.e., resulting in the highest percentage homology over the comparison window) generated by any of the various methods selected. Reference also may be made to the BLAST family of programs as for example disclosed by Altschul et al., 1997, Nucl. Acids Res. 25:3389. A detailed discussion of sequence analysis can be found in Unit 19.3 of Ausubel et al., "Current Protocols in Molecular Biology," John Wiley & Sons Inc, 1994-1998, Chapter 15.

"Stringency" as used herein refers to the temperature and ionic strength conditions, and presence or absence of certain organic solvents, during hybridization. The higher the stringency, the higher will be the observed degree of complementarity between sequences. "Stringent conditions" as used herein refers to temperature and ionic conditions under which only polynucleotides having a high proportion of complementary nucleobases, preferably having exact complementarity, will hybridize. The stringency required is nucleotide sequence dependent and depends upon the various components present during hybridization, and is greatly changed when nucleotide analogues are used. Generally, stringent conditions are selected to be about 10° C. to 20° C. less than the thermal melting point for the specific sequence at a defined ionic strength and pH. The Tm is the temperature (under defined ionic strength and pH) at which 50% of a target sequence hybridizes to a complementary probe. It will be understood that a polynucleotide will hybridize to a target sequence under at least low stringency conditions, preferably under at least medium stringency conditions and more preferably under high stringency conditions. Reference herein to low stringency conditions include and encompass from at least about 1% v/v to at least about 15% v/v formamide and from at least about 1 M to at least about 2 M salt for hybridization at 42° C., and at least about 1 M to at least about 2 M salt for washing at 42° C. Low stringency conditions also may include 1% Bovine Serum Albumin (BSA), 1 mM EDTA, 0.5 M NaHPO4 (pH 7.2), 7% SDS for hybridization at 65° C., and (i) 2×SSC, 0.1% SDS; or (ii) 0.5% BSA, 1 mM EDTA, 40 mM NaHPO4 (pH 7.2), 5% SDS for washing at room temperature. Medium stringency conditions include and encompass from at least about 16% v/v to at least about 30% v/v formamide and from at least about 0.5 M to at least about 0.9 M salt for hybridization at 42° C., and at least about 0.5 M to at least about 0.9 M salt for washing at 42° C. Medium stringency conditions also may include 1% Bovine Serum Albumin (BSA), 1 mM EDTA, 0.5 M NaHPO4 (pH 7.2), 7% SDS for hybridization at 65° C., and (i) 2×SSC, 0.1% SDS; or (ii) 0.5% BSA, 1 mM EDTA, 40 mM NaHPO4 (pH 7.2), 5% SDS for washing at 42° C. High stringency conditions include and encompass from at least about 31% v/v to at least about 50% v/v formamide and from at least about 0.01 M to at least about 0.15 M salt for hybridization at 42° C., and at least about 0.01 M to at least about 0.15 M salt for washing at 42° C. High stringency conditions also may include 1% BSA, 1 mM EDTA, 0.5 M NaHPO4 (pH 7.2), 7% SDS for hybridization at 65° C., and (i) 0.2×SSC, 0.1% SDS; or (ii) 0.5% BSA, 1 mM EDTA, 40 mM NaHPO4 (pH 7.2), 1% SDS for washing at a temperature in excess of 65° C. One embodiment of high stringency conditions includes hybridizing in 6×SSC at about 450 C, followed by one or more washes in 0.2×SSC, 0.1% SDS at 65° C. One embodiment of very high stringency conditions includes hybridizing 0.5 M sodium phosphate, 7% SDS at 65° C., followed by one or more washes at 0.2×SSC, 1% SDS at 65° C. Other stringent conditions are well known in the art. A skilled addressee will recognize that various factors can be manipulated to optimize the specificity of the hybridization. Optimization of the stringency of the final washes can serve to ensure a high degree of hybridization. For detailed examples, see CURRENT PROTOCOLS IN MOLECULAR BIOLOGY (supra) at pages 2.10.1 to 2.10.16 and MOLECULAR CLONING. A LABORATORY MANUAL (Sambrook, et al., eds.) (Cold Spring Harbor Press 1989) at sections 1.101 to 1.104.

The terms "substituent" and "substituent group", as used herein, are meant to include groups that are typically added to other groups or parent compounds to enhance desired properties or give desired effects. Substituent groups can be protected or unprotected and can be added to one available site or to many available sites in a parent compound. Substituent groups may also be further substituted with other substituent groups and may be attached directly or via a linking group such as an alkyl or hydrocarbyl group to the parent compound. Such groups include without limitation, halogen, hydroxyl, alkyl, alkenyl, alkynyl, acyl ($-C(O)R_a$), carboxyl ($-C(O)O-R_a$), aliphatic, alicyclic, alkoxy, substituted oxo ($-O-R_a$), aryl, aralkyl, heterocyclic, heteroaryl, heteroarylalkyl, amino ($-NR_bR_c$), imino($=NR_b$), amido ($-C(O)NR_bR_c$ or $-N(R_b)C(O)R_a$), azido ($-N_3$), nitro ($-NO_2$), cyano ($-CN$), carbamido ($-OC(O)NR_bR_c$ or $-N(R_b)C(O)OR_a$), ureido ($-N(R_b)C(O) NR_bR_c$), thioureido ($-N(R_b)C(S) NR_bR_c$), guanidinyl ($-N(R_b)C(=NR_b) NR_bR_c$), amidinyl ($-C(=NR_b)NR_bR_c$ or $-N(R_b)C(NR_b)R_a$), thiol ($-SR_b$), sulfinyl ($-S(O)R_b$), sulfonyl ($-S(O)_2R_b$) and sulfonamidyl ($-S(O)_2NR_bR_c$ or $-N(b)S(O)_2R_b$), wherein each $R_a$, $R_b$ and $R_c$ is a further substituent group with a preferred list including without limitation alkyl, alkenyl, alkynyl, aliphatic, alkoxy, acyl, aryl, aralkyl, heteroaryl, alicyclic, heterocyclic and heteroarylalkyl.

The terms "target nucleic acid sequence" and "target sequence" are used interchangeably herein to refer to a portion of a target RNA or target DNA molecule against which the targeting sequence of an oligomer compound of the invention is directed, that is, the sequence to which the oligomer compound will hybridize by Watson-Crick base-pairing of a complementary sequence.

The term "targeting sequence" as used herein refers to the sequence in an antisense oligomer compound of the present invention that is substantially complementary to the target sequence in a target RNA or target DNA molecule. The entire sequence, or only a portion, of the oligomer compound may be substantially complementary to the target sequence. For example, in an oligomer having 18 nucleobases, only 12-14 may be targeting sequences. Typically, the targeting sequence is formed of at least 10, 11, 12, 13, 14, 15, 16, 17, 18, 19, 20, 21, 22, 23, 24, 25, 26, 27, 28 or more contiguous bases in the oligomer compound, but may alternatively be formed of non-contiguous sequences that when placed together, e.g., from opposite ends of the oligomer, constitute sequence that spans the target sequence.

As used herein, the term "transcriptome" refers to the set of all messenger RNA (mRNA) molecules, or "transcripts", produced in one or a population of cells. The term can be applied to the total set of transcripts in a given organism, or to the specific subset of transcripts present in a particular cell type. Unlike the genome, which is roughly fixed for a given cell line (excluding mutations), the transcriptome can vary with external environmental conditions. Because it includes all mRNA transcripts in the cell (including pre-mRNA), the transcriptome reflects the genes that are being actively expressed at any given time, with the exception of mRNA degradation phenomena such as transcriptional attenuation.

As used herein, the terms "treatment", "treating", and the like, refer to obtaining a desired pharmacologic and/or physiologic effect. The effect may be therapeutic in terms of a partial or complete cure for a disease or condition (e.g., a hematologic malignancy) and/or adverse affect attributable to the disease or condition. These terms also cover any treatment of a condition or disease in a mammal, particularly in a human, and include: (a) inhibiting the disease or condition, i.e., arresting its development; or (b) relieving the disease or condition, i.e., causing regression of the disease or condition.

The term "tumor," as used herein, refers to any neoplastic cell growth and proliferation, whether malignant or benign, and all pre-cancerous and cancerous cells and tissues. The terms "cancer" and "cancerous" refer to or describe the physiological condition in mammals that is typically characterized in part by unregulated cell growth. As used herein, the term "cancer" refers to non-metastatic and metastatic cancers, including early stage and late stage cancers. The term "precancerous" refers to a condition or a growth that typically precedes or develops into a cancer. By "non-metastatic" is meant a cancer that is benign or that remains at the primary site and has not penetrated into the lymphatic or blood vessel system or to tissues other than the primary site. Generally, a non-metastatic cancer is any cancer that is a Stage 0, I, or II cancer, and occasionally a Stage III cancer. By "early stage cancer" is meant a cancer that is not invasive or metastatic or is classified as a Stage 0, I, or II cancer. The term "late stage cancer" generally refers to a Stage III or Stage IV cancer, but can also refer to a Stage II cancer or a substage of a Stage II cancer. One skilled in the art will appreciate that the classification of a Stage II cancer as either an early stage cancer or a late stage cancer depends on the particular type of cancer. Illustrative examples of cancer include, but are not limited to, breast cancer, prostate cancer, ovarian cancer, cervical cancer, pancreatic cancer, colorectal cancer, lung cancer, hepatocellular cancer, gastric cancer, liver cancer, bladder cancer, cancer of the urinary tract, thyroid cancer, renal cancer, carcinoma, melanoma, brain cancer, non-small cell lung cancer, squamous cell cancer of the head and neck, endometrial cancer, multiple myeloma, rectal cancer, and esophageal cancer. In an exemplary embodiment, the cancer is selected from prostate, lung, pancreatic, breast, ovarian and bone cancer.

The term "tumor-modulating" refers to a substance that inhibits or prevents the function of tumor cells and/or causes destruction of tumor cells. The tumor-modulating activity may be cytotoxic or cytostatic. Cytotoxic agents are toxic to tumor cells and the toxic effect may result in death and/or lysis of the tumor cells. In certain instances, the toxic effect may be a sublethal destructive effect on the tumor cell, e.g., slowing or arresting cell growth. Cytostatic agents inhibit or stop growth and/or proliferation of tumor cells.

As used herein, underscoring or italicizing the name of a gene shall indicate the gene, in contrast to its protein product, which is indicated by the name of the gene in the absence of any underscoring or italicizing. For example, "hSSB1" shall mean the hSSB1 gene, whereas "hSSB1" shall indicate the protein product or products generated from transcription and translation and alternative splicing of the "hSSB1" gene.

Each embodiment described herein is to be applied mutatis mutandis to each and every embodiment unless specifically stated otherwise.

2. Abbreviations

The following abbreviations are used throughout the application:
nt=nucleotide
nts=nucleotides
Da=Dalton(s)
kDa=kiloDalton(s)
min=minute(s)
hr=hour(s)
wk=week(s)
PD=phosphodiester
PS=phosphorothioate
LSA=PS oligomer compound
ASO=antisense oligonucleotide
GC=guanosine/cytosine
Tm=melting temperature
SSB1=single stranded DNA-binding protein 1, also known as NABP2, OBFC2B
SSB2=single stranded DNA-binding protein 2
hSSB1=human SSB1
hSSB2=human SSB2
mSSB1=mouse SSB1
THOC4=ALYREF, THO complex subunit 4
hTHOC4=human THOC4

3. Nucleic Acid Oligomeric Compounds for Targeting Tumor Cells

The present invention is predicated in part on the finding that nucleic acid oligomer compounds with a backbone comprising mostly phosphorothioate internucleoside linkages and at least about half the oligomer nucleobases being purines bind to one or both of SSB1 and THOC4, which are proteins involved, respectively, in DNA repair and in nuclear export of RNA molecules to the protein synthesis machinery of a cell. Unexpectedly, these oligomers have also been found to significantly inhibit proliferation or stimulate the death of tumor cells, regardless of whether or not they have substantial complementarity to the transcriptome, or whether or not that they have homology to the genome.

The present inventors have further explored this finding by testing over 300 oligomer sequences to determine features underlying the protein-binding and tumor cell-modulating activities. Of these sequences, 195 were found to bind with one or both of SSB1 and THOC4 and to inhibit proliferation, survival or viability of tumor cells. The sequence and chemistry of these oligomer compounds are shown in TABLE 2.

TABLE 2

| Oligomer Nucleobase Sequence & Chemistry | Seq Id |
|---|---|
| mC*mC*mA*mG*mU*mG*mA*mG*mC*mC*mG*mG*mA*mC*mU*mU*mG*mC*mC*mU | 1 |
| mC*mA*mG*mA*mG*mG*mC*mA*mG*mC*mA*mG*mU*mA*mC*mG*mA*mC*mG*mG | 2 |
| mG*mU*mG*mC*mA*mU*mG*mG*mA*mA*mU*mC*mA*mC*mG*mG*mA*mG*mU*mG | 3 |
| mC*mC*mA*mG*mU*mG*mA*mG*mC*mC*mG*mG*mA*mC*mU*mU*mG*mC*mC*mU | 5 |
| U*C*U*C*C*A*G*C*G*U*G*C*G*C*C*A*U | 6 |
| U*A*C*C*G*C*G*U*G*C*G*A*C*C*C*U*C*U | 7 |
| mU*mA*mC*mC*mG*mC*mG*mU*mG*mC*mG*mA*mC*mC*mC*mU*mC*mU | 10 |
| mG*mG*mU*mC*mG*mU*mA*mA*mU*mA*mC*mU*mU*mU*mC*mA*mC*mU*mU*mA | 12 |
| mU*mC*mA*mA*mG*mG*mA*mA*mG*mA*mU*mG*mG*mC*mA*mU*mU*mC*mU | 14 |
| mC*mU*mG*mC*mC*mU*mA*mA*mG*mU*mA*mA*mA*mA*mA*mG*mU*mG*mU*mA*mA*mA*mC | 15 |
| mC*mC*mA*mU*mC*mU*mG*mU*mA*mA*mU*mU*mA*mC*mA*mA*mA*mA*mU*mU*mA*mA*mA | 16 |

TABLE 2-continued

| Oligomer Nucleobase Sequence & Chemistry | Seq Id |
|---|---|
| mG*mA*mG*mU*mA*mA*mA*mC*mA*mU*mU*mC*mU*mG*mU*mG*mU*mG*mG*mA*mG*mU*mC | 17 |
| mC*mA*mG*mC*mA*mG*mC*mA*mG*mA*mG*mU*mC*mU*mC*mA*mU*mC*mA*mU | 21 |
| mU*mG*mU*mG*mC*mU*mA*mU*mU*mC*mU*mG*mU*mG*mA*mA*mU*mU | 22 |
| mU*mA*mA*mG*mC*mU*mA*mU*mU*mC*mU*mA*mU*mG*mU*mG*mU*mU | 23 |
| mG*mA*mG*mG*mA*mA*mC*TmC*mC*mG*mC*mC*mG*mC | 24 |
| mU*mC*mU*mU*mA*mU*mG*mU*mU*mU*mC*mC*mG*mA*mA*mC*mC*mG*mU*mU | 25 |
| mG*mG*mC*mG*mA*mA*mU*mG*mA*mG*mA*mC*mU*mU*mC*mU*mC*mU*mU*mA | 27 |
| mU*mC*mC*mU*mG*mG*mA*mU*mC*mC*mU*mU*mC*mA*mC*mA*mA*mU*mG | 28 |
| mU*mG*mU*mC*mA*mU*mA*mU*mU*mC*mC*mU*mG*mG*mA*mU*mC*mC*mU*mU | 29 |
| mC*mA*mG*mC*mA*mG*mC*mA*mG*mA*mG*mU*mA*mU*mU*mA*mU*mC*mA*mU | 31 |
| mG*mC*mU*mC*mC*mA*mG*mC*mA*mU*mC*mU*mG*mC*mU*mG*mC*mU*mU*mC | 32 |
| mG*mC*mU*mC*mC*mA*mG*mC*mA*mU*mC*mU*mG*mC*mU*mG*mC*mU*mU*mC | 33 |
| mA*mC*mA*mU*mC*mG*mU*mU*mA*mC*mC*mA*mG*mA*mC*mA*mG*mU*mG*mU*mU*mA | 34 |
| mA*mC*mA*mU*mG*mG*mU*mU*mC*mC*mC*mG*mA*mC*mA*mG*mU*mG*mU*mU*mA | 35 |
| mA*mG*mG*mC*mA*mA*mG*mU*mC*mC*mG*mG*mC*mU*mC*mA*mC*mU*mG*mG | 36 |
| mC*mG*mU*mG*mU*mC*mA*mU*mC*mC*mG*mC*mU*mC*mU*mC*mG*mA*mC*mU | 37 |
| mC*mC*mA*mG*mA*mC*mA*mG*mC*mU*mG*mG*mG*mU*mG*mC*mG*mC*mC*mU | 38 |
| mC*mC*mG*mG*mU*mG*mA*mG*mC*mG*mA*mC*mA*mC*mU*mA*mG*mG*mC*mU | 39 |
| mC*mC*mA*mG*mU*GAGCCGGACTmU*mG*mC*mC*mU | 40 |
| mC*mC*mA*mG*mU*mG*mA*mG*mC*mU*mG*mG*mA*mC*mU*mU*mG*mC*mC*mU | 41 |
| mC*mC*mA*mGmUmGmAmGmCmCmGmGmAmCmUmUmG*mC*mC*mU | 44 |
| mC*mG*mC*mG*mU*mC*mA*mU*mC*mG*mC*mA*mC*mU*mC*mG*mC*mC*mU | 45 |
| mU*mU*mG*mA*mC*mA*mG*mA*mU*mU*mA*mA*mG*mU*mC*mC*mA*mU*mU*mC | 51 |
| mG*mC*mC*mA*mC*mC*mC*mG*mU*mC*mG*mG*mU*mU*mG*mC*mU*mA*mG*mA | 52 |
| mG*mC*mG*mG*mG*mU*mC*mU*mU*mC*mU*mA*mA*mG*mC*mA*mU*mG*mA | 53 |
| mG*mC*mC*mC*mG*mC*mU*mC*mU*mG*mG*mC*mG*mC*mA*mU*mA*mG*mC*mU*mA | 54 |

| Oligomer Nucleobase Sequence & Chemistry | Seq Id |
|---|---|
| mG*mG*mG*mC*mC*mU*mC*mC*mC*mG*mC*mA*mC*mU*mU*mA*mG*mA*mU | 55 |
| mG*mG*mG*mA*mC*mG*mU*mC*mC*mC*mC*mA*mG*mU*mC*mA*mU*mG*mU | 56 |
| mC*mC*mU*mG*mU*mC*mA*mG*mC*mC*mG*mC*mA*mC*mU*mU*mG*mC*mC*mU | 59 |
| mC*mC*mA*mG*mU*mA*mA*mG*mC*mC*mA*mG*mA*mC*mU*mU*mG*mC*mA*mU | 61 |
| mC*mC*mA*mG*mU*mA*mG*mA*mG*mC*mC*mG*mA*mC*mU*mU*mC*mU*mC*mU | 62 |
| mC*mU*mA*mG*mU*mA*mA*mG*mC*mC*mG*mG*mA*mC*mU*mU*mG*mC*mC*mU | 63 |
| mC*mC*mA*mG*mG*mG*mA*mG*mC*mC*mG*mG*mA*mC*mU*mU*mG*mG*mC*mG | 64 |
| mG*mG*mG*mU*mG*mA*mA*mC*mC*mG*mA*mG*mU*mG*mG*mC*mU | 66 |
| mC*mC*mA*mG*mU*mG*mA*mG*mC*mC*mG*mG*mA*mC*mU*mU*mG*mC*mC | 67 |
| mC*mC*mA*mG*mU*mG*mA*mG*mC*mC*mG*mG*mA*mC*mU*mU*mG*mC | 68 |
| mC*mC*mA*mG*mU*mG*mA*mG*mC*mC*mG*mG*mA*mC*mU*mU*mG | 69 |
| mC*mC*mA*mG*mU*mG*mA*mG*mC*mC*mG*mG*mA*mC*mU*mU | 70 |
| mC*mC*mA*mG*mU*mG*mA*mG*mC*mC*mG*mG*mA*mC*mU | 71 |
| mC*mC*mA*mG*mU*mA*mG*mC*mC*mG*mG*mA*mC | 72 |
| mC*mC*mA*mG*mU*mG*mA*mG*mC*mC*mG*mG*mA | 73 |
| mC*mA*mG*mU*mG*mA*mG*mC*mC*mG*mG*mA*mC*mU*mU*mG*mC*mC*mU | 79 |
| mA*mG*mU*mG*mA*mG*mC*mC*mG*mG*mA*mC*mU*mU*mG*mC*mC*mU | 80 |
| mG*mU*mG*mA*mG*mC*mC*mG*mG*mA*mC*mU*mU*mG*mC*mC*mU | 81 |
| mU*mG*mA*mG*mC*mC*mG*mG*mA*mC*mU*mU*mG*mC*mC*mU | 82 |
| mG*mA*mG*mC*mC*mG*mG*mA*mC*mU*mU*mG*mC*mC*mU | 83 |
| mA*mG*mC*mC*mG*mG*mA*mC*mU*mU*mG*mC*mC*mU | 84 |
| mG*mC*mC*mG*mG*mA*mC*mU*mU*mG*mC*mC*mU | 85 |
| mC*mA*mG*mU*mG*mA*mG*mC*mC*mG*mG*mA*mC*mU*mU*mG*mC*mC | 91 |
| mA*mG*mU*mG*mA*mG*mC*mC*mG*mG*mA*mC*mU*mU*mG*mC | 92 |
| mG*mU*mG*mA*mG*mC*mC*mG*mG*mA*mC*mU*mU*mG | 93 |
| mU*mG*mA*mG*mC*mC*mG*mG*mA*mC*mU*mU | 94 |
| mC*mA*mG*mA*mG*GCAGCAGTACmG*mA*mC*mG*mG | 98 |
| mC*mA*mG*mAmGmGmCmAmGmCmAmGmUmAmCmGmA*mC*mG*mG | 100 |

TABLE 2-continued

| Oligomer Nucleobase Sequence & Chemistry | Seq Id |
|---|---|
| mG*mU*mC*mU*mC*mC*mG*mU*mC*mG*mU*mC*mA*mU*mG*mC*mU*mG*mC*mC | 101 |
| C*C*A*G*U*G*A*G*C*C*G*A*C*U*U*G*C*C*U | 103 |
| mC*mA*mG*mA*mG*mG*mC*mA*mG*mC*mA*mG*mU*mA*mC*mG*mA*mC*mG*mG*mC*mA*mA*mG*mG*mC*mA*mG*mC | 104 |
| mC*mA*mG*mA*mG*mG*mC*mA*mG*mC*mA*mG*mU*mA*mC | 105 |
| mG*mG*mA*mG*mC*mC*mG*mG*mA*mC*mA*mA*mG*mG*mG*TmC*mA*mC*mA | 107 |
| mG*mG*mG*mA*mC*mC*mC*mA*mA*mG*mG*mA*mG*mC*mG*TmA*mC*mG*mA | 108 |
| mG*mA*mG*mC*mG*mA*mG*mA*mC*mG*mC*mG*mG*mA*mG*mA*mC*mC*mA | 109 |
| mG*mC*mG*mG*mA*mA*mC*mG*mC*mA*mC*mG*mG*mA*mA*mG*mA*mC*mC | 110 |
| mG*mC*TmG*mA*mC*mG*mG*mC*mA*mC*mG*mG*mC*mA*mG*mA*mG*mA*mA | 111 |
| mG*mG*mG*mC*mG*mG*mC*mA*mG*mU*mA*mG*mU*mC*mC*mG*mA*mC*mA*mG | 113 |
| mG*mA*mG*mA*mA*mG*mA*mA*mG*mC*mA*mG*mU*mA*mC*mG*mA*mU*mG*mG | 114 |
| mC*mA*mU*mA*mG*mU*mC*mA*mC*mC*mU*mG*mU*mA*mC*mU*mA*mC*mC*mG | 115 |
| mC*mA*mC*mU*mC*mG*mC*mU*mG*mC*mA*mU*mU*mU*mC*mG*mC*mC*mG*mG | 117 |
| mC*mU*mG*mU*mG*mC*mC*mA*mU*mC*mU*mG*mU*mA*mC*mC*mA*mC*mG*mG | 118 |
| mC*mA*mG*mA*mG*mG*mC*mA*mG*mC*mA*mG*mU*mA*mC*mG*mA*mC*mG | 119 |
| mC*mA*mG*mA*mG*mG*mC*mA*mG*mC*mA*mG*mU*mA*mC*mG*mA*mC | 120 |
| mC*mA*mG*mA*mG*mG*mC*mA*mG*mC*mA*mG*mU*mA*mC*mG*mA | 121 |
| mC*mA*mG*mA*mG*mG*mC*mA*mG*mC*mA*mG*mU*mA*mC*mG | 122 |
| mA*mG*mA*mG*mG*mC*mA*mG*mC*mA*mG*mU*mA*mC*mG*mA*mC*mG*mG | 131 |
| mG*mA*mG*mG*mC*mA*mG*mC*mA*mG*mU*mA*mC*mG*mA*mC*mG*mG | 132 |
| mA*mG*mG*mC*mA*mG*mC*mA*mG*mU*mA*mC*mG*mA*mC*mG*mG | 133 |
| mG*mG*mC*mA*mG*mC*mA*mG*mU*mA*mC*mG*mA*mC*mG*mG | 134 |
| mG*mC*mA*mG*mC*mA*mG*mU*mA*mC*mG*mA*mC*mG*mG | 135 |
| mA*mG*mC*mA*mG*mU*mA*mC*mG*mA*mC*mG*mG | 137 |
| mG*mC*mA*mG*mU*mA*mC*mG*mA*mC*mG*mG | 138 |
| mA*mG*mA*mG*mG*mC*mA*mG*mC*mA*mG*mU*mC*mG*mA*mC*mG | 143 |
| mG*mA*mG*mG*mC*mA*mG*mC*mA*mG*mU*mA*mC*mG*mA*mC*mG*mA*mC | 144 |
| mA*mG*mG*mC*mA*mG*mC*mA*mG*mU*mA*mC*mG*mA | 145 |
| mG*mU*mG*mC*mCmAmUmGmGmAmAmUmCmAmCmCmGmA*mG*mU*mG | 152 |
| C*A*G*A*G*G*C*A*G*C*A*G*U*A*C*G*A*C*G*G | 153 |
| mG*mA*mG*mU*mC*mC*mG*mU*mG*mA*mG*mC*mG*mU*mA*mG*mA*mU*mA | 155 |
| mG*mC*mA*mU*mA*mG*mA*mC*mG*mU*mC*mG*mG*mA*mG*mA*mG*mU*mG*mU | 156 |
| mG*mU*mA*mG*mC*mA*mG*mC*mU*mC*mG*mU*mA*mA*mG*mA*mU | 158 |
| mG*mU*mG*mC*mA*mU*mG*mG*mA*mA*mU*mC*mA*mC*mG*mA*mG*mU*mG | 159 |
| mG*mG*mU*mA*mG*mG*mA*mC*mG*mC*mG*mG*mA*mC*mA*mG*mU*mU*mA*mU | 160 |
| mG*mU*mG*mC*mA*mU*mG*mG*mA*mA*mA*mC*mA*mC*mG*mG*mA*mU*mG | 161 |
| mC*mA*mG*mC*mA*mU*mA*mG*mA*mA*mU*mC*mA*mC*mG*mA*mG*mU*mG | 162 |
| mG*mU*mG*mC*mA*mA*mG*mA*mA*mU*mC*mA*mC*mG*mA*mG | 164 |
| mG*mU*mC*mC*mA*mU*mG*mU*mC*mU*mU*mC*mU*mC*mG*mC*mG*mA*mU*mG | 165 |
| mC*mU*mG*mC*mU*mU*mU*mG*mA*mA*mU*mC*mA*mC*mG*mC*mA*mG*mU*mU | 166 |
| mG*mU*mC*mC*mU*mU*mG*mU*mC*mA*mU*mA*mC*mG*mU*mG*mU*mG | 167 |
| mG*mU*mG*mC*mA*mU*mG*mG*mA*mA*mU*mC*mA*mC*mG*mG*mA*mG*mU | 168 |
| mG*mU*mG*mC*mA*mU*mG*mG*mA*mA*mU*mC*mA*mC*mG*mG*mA*mG | 169 |
| mG*mU*mG*mC*mA*mU*mG*mG*mA*mA*mU*mC*mA*mC*mG*mG*mA | 170 |
| mG*mU*mG*mC*mA*mU*mG*mG*mA*mA*mU*mC*mA*mC*mG*mG | 171 |
| mG*mU*mG*mC*mA*mU*mG*mG*mA*mA*mU*mC*mA*mC*mG | 172 |
| mG*mU*mG*mC*mA*mU*mG*mG*mA*mA*mU*mC*mA*mC | 173 |
| mG*mU*mG*mC*mA*mU*mG*mG*mA*mA*mU*mC*mA | 174 |
| mG*mU*mG*mC*mA*mU*mG*mG*mA*mA*mU*mC | 175 |
| mG*mU*mG*mC*mA*mU*mG*mG*mA*mA | 177 |
| mU*mG*mC*mA*mU*mG*mG*mA*mA*mU*mC*mA*mC*mG*mG*mA*mG*mU*mG | 180 |
| mG*mC*mA*mU*mG*mG*mA*mA*mU*mC*mA*mC*mG*mG*mA*mG*mU*mG | 181 |
| mC*mA*mU*mG*mG*mA*mA*mU*mC*mA*mC*mG*mG*mA*mG*mU*mG | 182 |
| mA*mU*mG*mG*mA*mA*mU*mC*mA*mC*mG*mG*mA*mG*mU*mG | 183 |
| mU*mG*mG*mA*mA*mU*mC*mA*mC*mG*mG*mA*mG*mU*mG | 184 |

TABLE 2-continued

| Oligomer Nucleobase Sequence & Chemistry | Seq Id |
|---|---|
| mG*mG*mA*mA*mU*mC*mA*mC*mG*mG*mA*mG*mU*mG | 185 |
| mG*mC*mA*mU*mG*mG*mA*mA*mU*mC*mA*mC*mG*mG*mA*mG | 191 |
| mC*mA*mU*mG*mG*mA*mA*mU*mC*mA*mC*mG*mG*mA | 192 |
| mC*mA*mC*mG*mU*mA*mC*mC*mU*mU*mA*mG*mU*mG*mC*mC*mU*mC*mA*mC*mC*mA*mC*mG*mU*mA*mC*mC*mU*mU | 196 |
| mC*mA*mC*mG*mU*mA*mC*mC*mU*mU*mA*mG*mU*mG*mC*mC*mU*mC*mA*mC | 198 |
| G*U*G*C*A*U*G*G*A*A*U*C*A*C*G*G*A*G*U*G | 203 |
| mG*mC*mG*mC*mU*mU*mA*mC*mC*mG*mU*mU*mC*mC*mU*mC*mA*mA*mC*mA | 206 |
| mG*mC*mA*mC*mG*mU*mC*mU*mC*mG*mC*mU*mC*mC*mA*mA*mU*mC*mU*mA | 207 |
| mC*mA*mC*mG*mU*mA*mC*mC*mU*mU*mA*mG*mA*mG*mC*mU*mC*mC*mC | 209 |
| mC*mA*mG*mG*mA*mA*mC*mG*mU*mA*mG*mU*mG*mG*mG*mU*mC*mA*mC | 210 |
| mC*mA*mC*mG*mU*mA*mG*mC*mA*mG*mA*mG*mU*mG*mG*mA*mC*mA*mC | 211 |
| mG*mU*mG*mC*mC*mU*mG*mU*mU*mA*mU*mC*mA*mC*mG*mC*mU*mC*mU*mG | 223 |
| mC*mA*mG*mA*mG*mG*mC*mA*mA*mG*mC*mA*mA*mU*mA*mA*mG*mA*mA*mG*mG | 224 |
| mC*mG*mU*mG*mA*mC*mG*mA*mA*mG*mA*mG*mU*mC*mG*mU*mC*mA*mC*mG | 225 |
| mC*mU*mG*mU*mA*mC*mG*mC*mG*mC*mG*mA*mA*mC*mG*mU*mA*mC*mA*mG | 226 |
| mC*mU*mG*mU*mA*mC*mG*mA*mG*mG*mA*mG*mA*mC*mG*mU*mA*mC*mA*mG | 227 |
| mA*mG*mU*mC*mG*mC*mG*mC*mG*mG*mG*mA*mU*mG*mA*mC*mG*mC*mG*mA*mC*mU | 228 |
| mC*mG*mU*mG*mA*mC*mG*mA*mC*mU*mC*mC*mU*mU*mC*mG*mU*mC*mA*mC*mG | 229 |
| mC*mU*mG*mU*mA*mC*mG*mU*mU*mC*mG*mC*mG*mC*mG*mU*mA*mC*mA*mG | 230 |
| mC*mU*mG*mU*mA*mC*mG*mU*mC*mU*mC*mC*mU*mC*mG*mU*mA*mC*mA*mG | 231 |
| mA*mG*mU*mC*mG*mC*mG*mG*mU*mC*mA*mU*mC*mC*mC*mG*mC*mG*mC*mG*mA*mC*mU | 232 |
| mG*mA*mA*mG*mC*mG*mU*mG*mA*mC*mG*mA*mA*mG*mG*mA*mG*mU*mC*mG*mU*mC*mA*mC*mG | 233 |
| mG*mA*mA*mG*mC*mG*mU*mG*mA*mC*mG*mA*mC*mU*mC*mC*mU*mU*mC*mG*mU*mC*mA*mC*mG | 234 |
| mC*mG*mU*mG*mA*mC*mG*mA*mA*mG*mG*mA*mG*mU*mC*mG*mU*mC*mA*mC*mG*mG*mA*mA*mG | 235 |
| mC*mG*mU*mG*mA*mC*mG*mA*mC*mU*mC*mC*mU*mU*mC*mG*mU*mC*mA*mC*mG*mG*mA*mA*mG | 236 |
| mA*mC*mC*mG*mA*mA*mA*mA*mA*mU*mA*mA*mA*mU*mC*mC*mA*mC*mU*mA | 237 |
| mU*mG*mU*mU*mG*mU*mU*mA*mU*mG*mU*mC*mC*mG*mU*mG*mC*mG*mA*mA | 238 |
| mC*mG*mG*mA*mC*mG*mU*mG*mC*mU*mC*mC*mA*mC*mG*mG*mU*mU*mC | 239 |
| mG*mU*mU*mA*mG*mA*mC*mC*mG*mU*mA*mC*mU*mG*mU*mG*mU*mA*mU*mU | 240 |
| mA*mU*mU*mC*mG*mU*mA*mU*mG*mA*mG*mA*mA*mC*mU*mA*mU*mC*mU*mG | 244 |
| mA*mA*mU*mG*mC*mG*mG*mU*mC*mG*mG*mU*mC*mC*mG*mC*mA*mU*mA*mU | 245 |
| mU*mC*mG*mU*mG*mA*mU*mA*mC*mU*mA*mA*mG*mG*mU*mG*mC*mC*mC | 247 |
| mU*mC*mC*mU*mU*mU*mU*mA*mU*mU*mU*mU*mC*mG*mG*mU*mG | 248 |
| mA*mC*mU*mU*mG*mC*mA*mA*mG*mU*mG*mU*mU*mC*mG*mA*mC*mG*mA*mG | 249 |
| mG*mG*mG*mC*mG*mU*mA*mC*mU*mA*mC*mG*mC*mG*mU*mC*mA*mC*mG*mA*mU*mG*mU*mC | 250 |
| mC*mG*mC*mU*mC*mU*mG*mG*mU*mU*mU*mU*mA*mG*mG*mC*mG*mU*mC*mA | 251 |
| mU*mA*mU*mU*mG*mC*mC*mG*mA*mU*mU*mG*mG*mU*mG*mG*mU*mA*mG | 252 |
| mG*mA*mC*mA*mG*mA*mC*mA*mG*mU*mA*mG*mA*mC*mA*mU*mG*mG | 253 |
| mU*mU*mC*mU*mG*mU*mC*mG*mA*mG*mU*mC*mA*mC*mU*mU*mU*mG*mU*mC*mA | 256 |
| mU*mU*mC*mU*mG*mU*mC*mA*mG*mG*mC*mU*mG*mG*mG*mG*mU*mU*mC*mG | 258 |
| mU*mC*mG*mU*mU*mU*mG*mA*mG*mG*mC*mA*mA*mG*mA*mA*mG*mC*mG*mU | 259 |
| mU*mU*mG*mA*mU*mC*mU*mA*mU*mU*mC*mU*mU*mU*mC*mG*mC*mA*mG*mG | 261 |
| mA*mA*mG*mG*mA*mG*mU*mU*mG*mU*mA*mG*mC*mA*mA*mC*mU*mC | 263 |
| mC*mG*mC*mA*mU*mA*mU*mG*mA*mA*mA*mC*mU*mC*mA*mU*mA*mC*mU*mG | 264 |
| mU*mA*mU*mC*mA*mG*mC*mC*mC*mG*mU*mU*mG*mU*mA*mC*mA*mG*mC*mA | 265 |
| mA*mU*mG*mC*mU*mA*mG*mG*mA*mG*mC*mU*mC*mU*mG*mC*mG*mA*mA | 269 |
| mC*mU*mG*mC*mA*mC*mC*mG*mA*mC*mG*mA*mA*mC*mU*mC*mU*mG*mU | 270 |
| mC*mC*mG*mA*mC*mA*mC*mG*mG*mC*mG*mG*mA*mA*mU*mU*mG*mU | 271 |
| mU*mU*mU*mU*mA*mA*mG*mC*mG*mC*mA*mA*mA*mA*mA*mU*mA*mA*mG | 272 |
| mC*mC*mA*mC*mG*mG*mU*mA*mU*mG*mU*mU*mC*mC*mU*mA*mG*mU*mU | 274 |
| mC*mU*mC*mC*mU*mC*mC*mU*mU*mA*mC*mG*mG*mA*mC*mA*mC*mU*mC | 277 |

TABLE 2-continued

| Oligomer Nucleobase Sequence & Chemistry | Seq Id |
|---|---|
| mC*mU*mC*mU*mU*mG*mG*mC*mU*mG*mA*mG*mC*mC*mC*mA*mU*mC*mU*mC | 278 |
| mG*mU*mC*mU*mC*mG*mU*mC*mG*mU*mC*mA*mU*mG*mC*mU*mG*mC*mC | 279 |
| mC*mU*mC*mG*mG*mC*mA*mC*mC*mC*mA*mC*mU*mG*mG*mA*mU*mG*mG | 280 |
| mG*mA*mU*mC*mG*mA*mU*mC*mG*mA*mU*mC*mG*mA*mU*mC*mG*mA*mU*mC | 281 |
| mG*mA*mG*mC*mC*mG*mU*mG*mG*mG*mG*mU*mG*mA*mC*mC*mU*mA*mC*mC | 282 |
| mG*mA*mC*mU*mU*mC*mG*mC*mA*mU*mG*mG*mG*mA*mA*mA*mC*mC*mA*mC | 283 |
| mG*mG*mU*mC*mA*mC*mU*mC*mG*mG*mC*mC*mU*mG*mA*mA*mC*mG*mG*mA | 284 |
| mC*mG*mG*mC*mU*mG*mU*mC*mA*mU*mC*mU*mC*mG*mC*mG*mC*mG*mG | 285 |
| mC*mC*mA*mG*mU*mG*mA*mG*mC*mC*mG*mG*mA*mC*mU*mU*mG*mC*mC*mU | 286 |
| mC*mC*mA*mG*mU*mG*mA*mG*mC*mC*mG*mG*mA*mC*mU*mU*mG*mC*mC*mU | 287 |
| mC*mU*mG*mA*mA*mG*mC*mG*mU*mA*mC*mC*mC*mU*mU*mU*mG*mG*mU*mG | 288 |
| mG*mA*mU*mG*mA*mC*mC*mU*mC*mC*mC*mC*mU*mG*mC*mA*mG*mU*mA | 289 |
| mC*mU*mC*mG*mG*mU*mG*mA*mU*mU*mA*mC*mG*mA*mU*mC*mG*mC*mG | 290 |
| mC*mA*mG*mC*mU*mC*mG*mU*mC*mC*mA*mU*mG*mC*mC*mG*mA*mA*mG | 291 |
| mA*mC*mG*mA*mU*mA*mG*mU*mC*mC*mC*mU*mG*mC*mC*mG*mC*mG*mA*mG | 292 |
| mU*mA*mG*mU*mC*mC*mG*mC*mU*mU*mA*mC*mG*mC*mC*mG*mA*mG | 293 |
| mC*mU*mA*mC*mU*mG*mG*mA*mG*mG*mG*mG*mA*mC*mG*mU*mC*mC*mA*mU | 295 |
| mA*mG*mG*mC*mA*mA*mG*mT*mC*mC*mG*mG*mC*mT*mC*mA*mC*mT*mG*mG | 296 |
| mC*mU*mU*mG*mG*mG*mG*mG*mG*mU*mC*mU*mA*mG*mA*mG*mG*mA*mA*mG | 297 |
| mC*mG*mG*mA*mU*mG*mG*mA*mA*mA*mA*mG*mG*mG*mU*mC*mC*mA*mG*mU | 298 |
| mG*mA*mG*mA*mG*mG*mG*mA*mA*mU*mG*mC*mC*mU*mG*mU*mG*mA*mG | 299 |
| mA*mC*mC*mG*mA*mA*mC*mG*mG*mA*mC*mA*mU*mU*mU*mC*mG*mA*mA*mG | 300 |
| mG*mC*mC*mG*mA*mC*mA*mG*mU*mA*mG*mA*mG*mG*mC*mG*mC*mG*mC | 301 |
| mG*mA*mG*mA*mA*mC*mC*mG*mA*mC*mU*mC*mG*mG*mG*mU*mA*mG*mA*mG | 303 |

In TABLE 2, m represents a 2'OMe-modified nucleoside, and * represents a phosphorothioate (PS) internucleoside linkage.

Based on these findings, the present invention broadly relates to oligomer compounds that have the following features:
 a) a backbone comprising at least about 70% phosphorothioate internucleoside linkages;
 b) (i) a purine content of at least about 50%, or (ii) a purine content of at least about 45% with a guanosine-cytosine (GC) content of at least about 50%;
 c) a length of at least 14 nucleobases and no more than 29 nucleobases;
 d) binding to one or both of THOC4 and SSB1 in an aqueous solution comprising 10 mM Tris-HCl (pH8.0) and 100 mM NaCl at 37° C.; and
 e) cause apoptosis or necrosis of tumor cells in vivo or in vitro.

It has also been determined that in addition to SSB1, the oligomer compounds of the present invention also bind to SSB2 in an aqueous solution comprising 10 mM Tris-HCl (pH8.0) and 100 mM NaCl at 37° C. Based on this determination, and the observation that SSB1 (including hSSB1 and mSSB1) and SSB2 are each oligonucleotide/oligosaccharide binding (OB)-fold proteins, it is proposed that the oligomer compounds disclosed herein bind OB-fold proteins generally.

The present inventors have also found that these oligomer compounds typically have the following features:
 f) a melting temperature (Tm) in the range of 45° C. to 80° C.;
 g) preferential uptake by tumor cells;
 h) inhibit translocation of mRNA from the nucleus to the cytoplasm of tumor cells.

3.1 Oligomer Chemistry and Design

Oligomeric compounds of the present invention are generally single stranded and are preferably at least 14 (e.g., 14, 15, 16, 17, 18, 19 or more) nucleobases in length (i.e., at least 14, 15, 16, 17, 18, 19 or more linked nucleosides/monomeric subunits) and no more than 29 (e.g., 29, 28, 27, 26, 25, 24, 23, 22, 21 or less) nucleobases in length (i.e., no more than 29, 28, 27, 26, 25, 24, 23, 22, 21 or less or more linked nucleosides/monomeric subunits). In specific embodiments, the oligomers are between 14 and 28, 14 and 27, 14 and 26, 14 and 25, 14 and 24, 14 and 23, 14 and 22, 14 and 21, 14 and 20, 15 and 29, 15 and 28, 15 and 27, 15 and 26, 15 and 25, 15 and 24, 15 and 23, 15 and 22, 15 and 21, 15 and 20, 16 and 29, 16 and 28, 16 and 27, 16 and 26, 16 and 25, 16 and 24, 16 and 23, 16 and 22, 16 and 21, 16 and 20, 17 and 29, 17 and 28, 17 and 27, 17 and 26, 17 and 25, 17 and 24, 17 and 23, 17 and 22, 17 and 21, 17 and 20, 18 and 29, 18 and 28, 18 and 27, 18 and 26, 18 and 25, 18 and 24, 18 and 23, 18 and 22, 18 and 21, 18 and 20, 19 and 29, 19 and 28, 19 and 27, 19 and 26, 19 and 25, 19 and 24, 19 and 23, 19 and 22, 19 and 21, or 19 and 20 nucleobases in length. One of ordinary skill in the art will appreciate that the invention thus embodies oligomeric compounds of 14, 15, 16, 17, 18, 19, 20, 21, 22, 23, 24, 25, 26, 27, 28 or 29 nucleobases in length.

3.2 Backbone Chemistry

3.2.1 Internucleoside Linkages

The oligomer backbone comprises at least about 70% phosphorothioate internucleoside linkages. In this regard, not all the internucleoside linkages need to comprise phosphorothioate internucleoside linkages and the present invention thus encompasses oligomeric compounds with mixed backbones that also comprise alternative internucleoside linkages such as phosphodiester, phosphorodithioate, phosphonate, methyl phosphonate, alkyl phosphonate, 3'-alkylene phosphonate, 5'-alkylene phosphonate, chiral phosphonate, phosphonoacetate, thiophosphonoacetate, phosphinate, phosphoramidate, 3'-amino phosphoramidate, aminoalkylphosphoramidate, thionophosphoramidate, phosphorothioamidate, thionoalkylphosphonate, phosphotriester, thionoalkylphosphotriester, aminoalkylphosphotriester, thionoalkylphosphotriester selenophosphate, and/or boranophosphate internucleoside linkages. In some embodiments, at least about 70%, 80%, 90% or even 100% of the internucleoside linkages of the oligomer backbone comprise phosphorothioate internucleoside linkages. In preferred embodiments, all internucleoside linkages of the oligomer backbone comprise phosphorothioate internucleoside linkages.

Representative oligomer backbones with at least about 70% phosphorothioate internucleoside linkages (PIL) encompass at least 10 PIL in a 14-nucleobase oligomer, at least 10 or 11 PIL in a 15-nucleobase oligomer, at least 11 PIL in a 16-nucleobase oligomer, at least 12 PIL in a 17-nucleobase oligomer, at least 12 or 13 PIL in a 18-nucleobase oligomer, at least 13 PIL in a 19-nucleobase oligomer, at least 14 PIL in a 20-nucleobase oligomer, at least 14 or 15 PIL in a 21-nucleobase oligomer, at least 15 PIL in a 22-nucleobase oligomer, at least 16 PIL in a 23-nucleobase oligomer, at least 17 PIL in a 24-nucleobase oligomer, at least 17 or 18 PIL in a 25-nucleobase oligomer, at least 18 PIL in a 26-nucleobase oligomer, at least 19 PIL in a 27-nucleobase oligomer, at least 19 or 20 PIL in a 28-nucleobase oligomer and at least 20 PIL in a 29-nucleobase oligomer.

Representative numbers of PIL as a function of oligomer length for 80% and 90% PIL can be calculated from TABLE 1 supra.

Any alternative internucleoside linkages (i.e., internucleoside linkages other than PIL), may be at one or both ends of the oligomer, may be in a central portion of the oligomer, may be adjacent to each other, and or may be dispersed throughout the oligomer.

3.2.2 Modified Sugar Moieties

The backbone of the oligomer suitably comprises at least one 2'-O-alkyl modified sugar moiety, illustrative examples of which include 2'-O-methyl, 2'-O-methoxyethyl and 2'-O-2-methoxyethyl modified sugar moieties. (e.g., 2'-O-methyl sugar moiety). In specific examples, the oligomer comprises at least one 2'-O-methyl ribose moiety. Suitably, at least about 50%, 60%, 70%, 80%, 90% or all of the sugar moieties of the oligomer are each a 2'-O-alkyl modified sugar moiety (e.g., 2'-O-methyl modified sugar moiety). In specific embodiments, all sugar moieties of the oligomer are each a 2'-O-alkyl modified sugar moiety (e.g., 2'-O-methyl modified sugar moiety).

Representative MSM contents of at least about 50% encompass at least 7 MSM nucleobases in a 14-nucleobase oligomer, at least 7 or 8 MSM nucleobases in a 15-nucleobase oligomer, at least 8 MSM nucleobases in a 16-nucleobase oligomer, at least 8 or 9 MSM nucleobases in a 17-nucleobase oligomer, at least 9 MSM nucleobases in a 18-nucleobase oligomer, at least 9 or 10 MSM nucleobases in a 19-nucleobase oligomer, at least 10 MSM nucleobases in a 20-nucleobase oligomer, at least 10 or 11 MSM nucleobases in a 21-nucleobase oligomer, at least 11 MSM nucleobases in a 22-nucleobase oligomer, at least 11 or 12 MSM nucleobases in a 23-nucleobase oligomer, at least 12 MSM nucleobases in a 24-nucleobase oligomer, at least 12 or 13 MSM nucleobases in a 25-nucleobase oligomer, at least 13 MSM nucleobases in a 26-nucleobase oligomer, at least 13 or 14 MSM nucleobases in a 27-nucleobase oligomer, at least 14 MSM nucleobases in a 28-nucleobase oligomer and at least 14 or 15 MSM nucleobases in a 29-nucleobase oligomer.

Representative numbers of MSM nucleobases as a function of oligomer length for 60%, 70%, 80% or 90% MSM contents can be calculated from TABLE 1 supra.

3.3 Nucleobase Sequences

Nucleobase sequences may be designed using any suitable technique to achieve a purine and/or GC content and/or Tm, as described for example below. For non-targeting oligomers of the present invention, the nucleobase sequences can be generated using a random sequence generator (e.g., a random sequence generator tool located at the Swiss-Prot website: http://au.expasy.org/tools/randseq.html) or rational design and screened by suitable sequence analysis means (e.g., BLAST) so that the nucleobase has the appropriate sequence identity to the selected transcriptome and/or genome. Alternatively, for antisense oligomers, a nucleic acid sequence of interest can be analyzed using suitable analysis means (e.g., OligoAnalyzer, Primer3, PrimerQuest, etc.) to identify a target sequence with appropriate purine and/or GC content and/or Tm.

3.3.1 Purine Content

The nucleobase sequence of the oligomers suitably has a purine content of at least about 45% and no more than about 90%, e.g., a purine content of about 45%, about 50%, about 55%, about 60%, about 65%, about 70%, about 75%, about 80%, about 85% or about 90%. In specific embodiments, the oligomers have a purine content of about 45-90%, about 45-85%, about 45-80%, about 45-75%, about 45-70%, about 45-65%, about 45-60%, about 45-55%, about 45-50%, about 50-90%, about 50-85%, about 50-80%, about 50-75%, about 50-70%, about 50-65%, about 50-60%, about 50-55%, about 55-90%, about 55-85%, about 55-80%, about 55-75%, about 55-70%, about 55-65% or about 55-60%.

Representative purine contents of at least about 45% encompass at least 6 purines in a 14-nucleobase oligomer, at least 6 or 7 purines in a 15-nucleobase oligomer, at least 7 purines in a 16-nucleobase oligomer, at least 7 or 8 purines in a 17-nucleobase oligomer, at least 8 purines in a 18-nucleobase oligomer, at least 8 or 9 purines in a 19-nucleobase oligomer, at least 9 purines in a 20-nucleobase oligomer, at least 9 to 10 purines in a 21-nucleobase oligomer, at least 10 purines in a 22-nucleobase oligomer, at least 10 purines in a 23-nucleobase oligomer, at least 10 or 11 purines in a 24-nucleobase oligomer, at least 11 purines in a 25-nucleobase oligomer, at least 11 or 12 purines in a 26-nucleobase oligomer, at least 12 purines in a 27-nucleobase oligomer, at least 12 or 13 purines in a 28-nucleobase oligomer and at least 13 purines in a 29-nucleobase oligomer.

Representative numbers of purine nucleobases as a function of oligomer length for 50%, 60%, 70%, 80% or 90% purine contents can be calculated from TABLE 1 supra.

3.3.2 GC Content

The nucleobase sequence of the oligomers may have a GC content of at least about 50% and no more than about 90%, e.g., a GC content of about 50%, about 55%, about 60%, about 65%, about 70%, about 75%, about 80%, about 85% or about 90%. In specific embodiments, the oligomers have a GC content of 50-90%, 50-85%, 50-80%, 50-75%, 50-70%, 50-65%, 50-60%, 50-55%, 55-90%, 55-85%, 55-80%, 55-75%, 55-70%, 55-65% or 55-60%.

Representative GC contents of at least about 50% encompass at least 7 G/C in a 14-nucleobase oligomer, at least 7 or 8 G/C in a 15-nucleobase oligomer, at least 8 G/C in a 16-nucleobase oligomer, at least 8 or 9 G/C in a 17-nucleobase oligomer, at least 9 G/C in a 18-nucleobase oligomer, at least 9 or 10 G/C in a 19-nucleobase oligomer, at least 10 G/C in a 20-nucleobase oligomer, at least 10 or 11 G/C in a 21-nucleobase oligomer, at least 11 G/C in a 22-nucleobase oligomer, at least 11 or 12 G/C in a 23-nucleobase oligomer, at least 12 G/C in a 24-nucleobase oligomer, at least 12 or 13 G/C in a 25-nucleobase oligomer, at least 13 G/C in a 26-nucleobase oligomer, at least 13 or 14 G/C in a 27-nucleobase oligomer, at least 14 G/C in a 28-nucleobase oligomer and at least 14 or 15 G/C in a 29-nucleobase oligomer.

Representative numbers of G/C nucleobases as a function of oligomer length for 60%, 70%, 80% or 90% GC contents can be calculated from TABLE 1 supra.

3.3.3 Purine and GC Content Embodiments

In certain embodiments, the nucleobase sequence of the oligomers has a purine content of at least about 45% and no more than about 90% as described above, and a GC content of at least about 50% and no more than about 90% as described above.

In other embodiments, the nucleobase sequence of the oligomers has a purine content of at least about 50% and no more than about 90%, and a GC content of less than about 50% and more than 10%, e.g., about 50%, about 45%, about 40%, about 35%, about 30%, about 25%, about 20%, about 15% or about 10%. In illustrative examples of this type, the oligomers have a purine content of about 45-90%, about 45-85%, about 45-80%, about 45-75%, about 45-70%, about 45-65%, about 45-60%, about 45-55% or about 45-50% and a GC content of about 10-50%, about 15-50%, about 20-50%, about 25-50%, about 30-50%, about 35-50%, about 40-50%, about 45-50%, about 10-45%, about 15-45%, about 20-45%, about 25-45%, about 30-45%, about 35-45%, about 40-45%, about 10-40%, about 15-40%, about 20-40%, about 25-40%, about 30-40% or about 35-40%.

3.3.4 Melting Temperature

The oligomers suitably have a melting temperature (Tm) of at least about 45° C. and generally no more than 80° C. (e.g., about 45, 46, 47, 48, 49, 50, 51, 52, 53, 54, 55, 56, 57, 58, 59, 60, 65, 70, 75 or 80° C.). In specific embodiments, the oligomers have a Tm of 45-80° C., 45-75° C., 45-70° C., 45-65° C., 45-60° C., 45-55° C., 45-50° C., 50-80° C., 50-75° C., 50-70° C., 50-65° C., 50-60° C. or 50-55°.

3.3.5 Non-Targeting Oligomers

Most of the oligomers presented in TABLE 2 significantly inhibit proliferation or stimulate the death of tumor cells, but lack substantial complementarity to the transcriptome, and/or homology to the genome.

The oligomer nucleobase sequences of the present invention may lack perfect complementarity to the transcriptome of a target tumor cell and often also lack perfect complementarity to the genome of a mammal from which the target tumor cell is suitably derived. In some embodiments, the nucleobase sequence over the length of the oligomer lacks substantially complementarity to the transcriptome. Suitably, no more than about 95%, 90%, 85%, 80%, 75%, 70%, 65%, 60%, 55%, 50%, 45%, 40%, 35% 30%, 25%, 20%, 15%, 10%, 5%, 4%, 3%, 2%, 1% of the nucleobases of the oligomer are able to engage in base-pairing with the transcriptome. In illustrative examples of this type, an oligomer of 14 to 29 nucleobases with no more than 95% of its nucleobases able to engage in base-pairing with the transcriptome has at least one non-complementary nucleobase that is unable to base-pair with a nucleobase of a reference nucleobase sequence of the transcriptome. In other illustrative examples, an oligomer an oligomer of 14 to 29 nucleobases with no more than 90% of its nucleobases able to engage in base-pairing with the transcriptome has at least two non-complementary nucleobases that are unable to base-pair with a nucleobase of a reference nucleobase sequence of the transcriptome.

In some embodiments, the nucleobase sequence over the length of the oligomer lacks homology to the genome of a mammal from which the tumor cell is suitably derived. Suitably, the nucleobase sequence over the length of the oligomer has no more than about 95%, 90%, 85%, 80%, 75%, 70%, 65%, 60%, 55%, 50%, 45%, 40%, 35% 30%, 25%, 20%, 15%, 10%, 5%, 4%, 3%, 2%, 1% sequence identity to any equal length of contiguous nucleobases defining a reference nucleobase sequence in the genome. In illustrative examples of this type, an oligomer of 14 to 29 nucleobases with no more than 95% sequence identity to the reference nucleobase sequence in the genome has at least one nucleobase that is not identical to, or does not have the same or equivalent nucleobase-pairing ability as, a nucleobase at a matching position of the reference nucleobase sequence. In other illustrative examples, an oligomer of 14 to 29 nucleobases with no more than 90% sequence identity to the reference nucleobase sequence in the genome has at least two nucleobases that are not identical to, or do not have the same or equivalent nucleobase-pairing ability as, a nucleobase at a matching position of the reference nucleobase sequence.

Representative numbers of nucleobases as a function of oligomer length and percentage of nucleobases able to engage in base-pairing or having sequence identity can be calculated from TABLE 1 supra.

In specific embodiments, the non-targeting oligomer nucleobase sequence is selected from any one of SEQ ID NO: 1, 2, 3, 5, 7, 36, 37, 38, 39, 40, 41, 44, 45, 51, 52, 53, 54, 55, 56, 59, 61, 62, 63, 64, 66, 67, 68, 69, 70, 71, 72, 73, 79, 80, 81, 82, 83, 84, 85, 91, 92, 93, 94, 98, 100, 103, 104, 105, 107, 108, 109, 110, 111, 113, 114, 115, 117, 118, 119, 120, 121, 122, 131, 132, 133, 134, 135, 137, 138, 143, 144, 145, 152, 153, 155, 156, 158, 159, 160, 161, 162, 164, 165, 166, 167, 168, 169, 170, 171, 172, 173, 174, 175, 177, 180, 181, 182, 183, 184, 185, 191, 192, 196, 198, 203, 206, 207, 209, 210, 211, 223, 224, 225, 226, 227, 228, 229, 230, 231, 232, 233, 234, 235, 236, 237, 238, 239, 240, 244, 245, 247, 248, 249, 250, 251, 252, 253, 256, 258, 259, 261, 263, 264, 265, 269, 270, 271, 272, 274, 277, 281, 282, 283, 286, 287, 290, 291, 292, 293, 295, 296, 298, 300, 301 and 303.

3.3.6 Antisense Oligomers

It has also been found that antisense oligomers with specificity to a particular target sequence can be adapted to bind SSB1 and/or THOC4 by including in the oligomer design the backbone chemistry and base content described above. These oligomers have also been found to cause apoptosis or necrosis of tumor cells in vivo or in vitro, regardless of the gene to which the antisense oligomer is targeted. Otherwise, the targeting sequence of an antisense oligomer can be designed using standard antisense design programs and analysis tools known in the art.

Thus, the nucleobase sequence of the subject antisense oligomers will typically have substantial complementarity to an antisense strand of a selected gene. In these embodiments, the nucleobase sequence is suitably complementary to and capable of hybridizing to a target sequence of the selected gene or transcript thereof, including a pre-mRNA or mRNA molecule encoded by the selected gene, under high stringency conditions. The antisense oligomers can be tested for efficacy using a variety of techniques known in the art.

For example, an antisense oligomer can be tested for heteroduplex formation. The effectiveness of a given antisense oligomer in forming a heteroduplex with the target nucleic acid sequence may be determined by screening methods known in the art. For example, the oligomer may be incubated in a cell culture containing an mRNA preferentially expressed in tumor cells, and the effect on the target mRNA is evaluated by monitoring the presence or absence of (1) heteroduplex formation with the target sequence and non-target sequences using procedures known to those of skill in the art, (2) the amount of the target mRNA expressed by tumor cells, as determined by standard techniques such as RT-PCR or Northern blot, (3) the amount of protein transcribed from the target mRNA, as determined by standard techniques such as ELISA or Western blotting. Alternatively, or in addition, the effectiveness of an antisense oligomer can be determined by measuring expression of a targeted gene in tumor cells treated with the antisense oligomer.

In specific embodiments, the antisense oligomer targets eIF-4E or SSB1. Illustrative antisense oligomer nucleobase sequences are suitably selected from any one of SEQ ID NO: 6, 10, 12, 14, 15, 16, 17, 21, 22, 23, 24, 25, 27, 28, 29, 31, 32, 33, 34, 35, 101, 278, 279, 280, 284, 285, 288, 289, 297 and 299.

3.4 Oligomer Property Modifications

The present invention also contemplates modifications that can enhance the properties of an oligomeric compound of the invention or can be used to track the oligomeric compound or its metabolites, including the attachment of one or more moieties or conjugates. Properties that are typically enhanced include without limitation activity, cellular distribution and cellular uptake. In some embodiments, such modified oligomeric compounds are prepared by covalently attaching conjugate groups to functional groups available on an oligomeric compound such as hydroxyl or amino functional groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve properties including but not limited to oligomer uptake and/or enhance oligomer resistance to degradation. Groups that enhance the pharmacokinetic properties, in the context of this invention, include groups that improve properties including but not limited to oligomer uptake, distribution, metabolism and excretion. Representative conjugate groups are disclosed in International Patent Application PCT/US92/09196.

Conjugate groups include but are not limited to lipid moieties such as a cholesterol moiety (Letsinger et al., *Proc. Natl. Acad. Sci. USA,* 1989, 86, 6553-6556), cholic acid (Manoharan et al., *Bioorg. Med. Chem. Let.,* 1994, 4, 1053-1060), a thioether, e.g., hexyl-S-tritylthiol (Manoharan et al., *Ann. N.Y. Acad. Sci.,* 1992, 660, 306-309; Manoharan et al., *Bioorg. Med. Chem. Let.,* 1993, 3, 2765-2770), a thiocholesterol (Oberhauser et al., *Nucl. Acids Res.,* 1992, 20, 533-538), an aliphatic chain, e.g., dodecandiol or undecyl residues (Saison-Behmoaras et al., *EMBO J.,* 1991, 10, 1111-1118; Kabanov et al., *FEBS Lett.,* 1990, 259, 327-330; Svinarchuk et al., *Biochimie,* 1993, 75, 49-54), a phospholipid, e.g., di-hexadecyl-rac-glycerol or triethylammonium 1,2-di-O-hexadecyl-rac-glycero-3-H-phosphonate (Manoharan et al., *Tetrahedron Lett.,* 1995, 36, 3651-3654; Shea et al., *Nucl. Acids Res.,* 1990, 18, 3777-3783), a polyamine or a polyethylene glycol chain (Manoharan et al., *Nucleosides & Nucleotides,* 1995, 14, 969-973), or adamantane acetic acid (Manoharan et al., *Tetrahedron Lett.,* 1995, 36, 3651-3654), a palmityl moiety (Mishra et al., *Biochim. Biophys. Acta,* 1995, 1264, 229-237), or an octadecylamine or hexylamino-carbonyl-oxycholesterol moiety (Crooke et al., *J. Pharmacol. Exp. Ther.,* 1996, 277, 923-937).

The oligomeric compounds of the present invention may also be conjugated to active drug substances, for example, aspirin, warfarin, phenylbutazone, ibuprofen, suprofen, fenbufen, ketoprofen, (S)-(+)-pranoprofen, carprofen, dansylsarcosine, 2,3,5-triiodobenzoic acid, flufenamic acid, folinic acid, a benzothiadiazide, chlorothiazide, a diazepine, indomethicin, a barbiturate, a cephalosporin, a sulfa drug, an antidiabetic, an antibacterial or an antibiotic. Oligonucleotide-drug conjugates and their preparation are described in U.S. patent application Ser. No. 09/334,130, which is incorporated hereby by reference in its entirety.

Oligomeric compounds of the present invention can also be modified to have one or more stabilizing groups that are generally attached to one or both termini of oligomeric compounds to enhance properties such as for example nuclease stability. Included in stabilizing groups are cap structures. These terminal modifications protect the oligomeric compounds having terminal nucleic acid moieties from exonuclease degradation, and can help in delivery and/or localization within a cell. The cap can be present at the 5-terminus (5'-cap) or at the 3'-terminus (3'-cap) or can be present on both termini. In non-limiting examples, the 5-cap includes inverted abasic residue (moiety), 4',5'-methylene nucleotide; 1-(beta-D-erythrofuranosyl) nucleotide, 4'-thio nucleotide, carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl nucleotide, 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety (for more details see Wincott et al., International PCT publication No. WO 97/26270, incorporated by reference herein).

Exemplary 3'-cap structures include, for example 4',5'-methylene nucleotide; 1-(beta-D-erythrofuranosyl) nucleotide; 4'-thio nucleotide, carbocyclic nucleotide; 5'-aminoalkyl phosphate; 1,3-diamino-2-propyl phosphate, 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moiety; 5'-5'-inverted abasic moiety; 5'-phosphoramidate; 5'-phosphorothioate; 1,4-butanediol phosphate; 5'-amino; bridging and/or non-bridging 5'-phosphoramidate, phosphorothioate and/or phosphorodithioate, bridging or non bridging methylphosphonate and 5'-mercapto moieties (for more details see Beaucage and Tyer, 1993, Tetrahedron 49, 1925 and Published U.S. Patent Application Publication Number US 2005/0020525 published on Jan. 27, 2005).

The oligomers of the present invention can be prepared using methods well known to those skilled in the art, including literature procedures for DNA like compounds (Protocols for Oligonucleotides and Analogs, Ed. Agrawal (1993), Humana Press) and/or RNA like compounds (Scaringe, *Methods,* 2001, 23, 206-217. Gait et al., Applications of Chemically synthesized RNA in RNA:Protein Interactions, Ed. Smith (1998), 1-36. Gallo et al., *Tetrahedron*, 2001, 57, 5707-5713) synthesis as appropriate.

Alternatively, oligomeric compounds of the invention may be purchased from various oligonucleotide synthesis companies such as, for example, Sigma-Aldrich Inc. (Castle Hill, NSW, Australia). Irrespective of the particular protocol used, the subject oligomeric compounds may be conveniently and routinely made through the well-known technique of solid phase synthesis. Equipment for such synthesis is sold by several vendors including, for example, Applied Biosystems (Foster City, Calif.). Any other means for such synthesis known in the art may additionally or alternatively be employed (including solution phase synthesis). Methods of purification and analysis of oligomeric compounds are known to those skilled in the art. Analysis methods include capillary electrophoresis (CE) and electrospray-mass spectroscopy. The method of the invention is not limited by the method of oligomer synthesis or purification.

3.5 Oligomer Properties

The oligomer compounds may be taken up by tumor cells by facilitated or active transport across the tumor cell membrane when administered in free (non-complexed) form, or by an endocytotic mechanism when administered in complexed form. The oligomer may be a substrate for a membrane transporter system (i.e., a membrane protein or proteins) capable of facilitating transport or actively transporting the oligomer across the cell membrane. This feature may be determined by one of a number of tests for oligomer interaction or cell uptake, as follows.

A first test assesses binding at cell surface receptors, by examining the ability of an oligomer compound to displace or be displaced by a selected charged oligomer on a cell surface. The cells are incubated with a given quantity of test oligomer, which is typically fluorescently labeled, at a final oligomer concentration of between about 10-300 nM. Shortly thereafter, e.g., 10-30 minutes (before significant internalization of the test oligomer can occur), the displacing compound is added, in incrementally increasing concentrations. If the test compound is able to bind to a cell surface receptor, the displacing compound will be observed to displace the test compound. If the displacing compound is shown to produce 50% displacement at a concentration of 10× the test compound concentration or less, the test compound is considered to bind at the same recognition site for the cell transport system as the displacing compound.

A second test measures cell transport, by examining the ability of the test compound to transport a labeled reporter, e.g., a fluorescence reporter, into cells. The cells are incubated in the presence of labeled test compound, added at a final concentration between about 10-300 nM. After incubation for 30-120 minutes, the cells are examined, e.g., by microscopy, for intracellular label. The presence of significant intracellular label is evidence that the test compound is transported by facilitated or active transport.

The oligomer compound may also be administered in complexed form, where the complexing agent is typically a polymer, e.g., a cationic lipid, polypeptide, or non-biological cationic polymer, having an opposite charge to any net charge on the oligomer. Methods of forming complexes, including bilayer complexes, between anionic oligonucleotides and cationic lipid or other polymer components, are well known. For example, the liposomal composition Lipofectin™ (Feigner et al. *Proc Natl Acad Sci USA*, 1987, 84(21): 7413-7417), containing the cationic lipid DOTMA (N-[1-(2,3-dioleyloxyl)propyl]-N,N,N-trimethylammonium chloride) and the neutral phospholipid DOPE (dioleyl phosphatidyl ethanolamine), is widely used. After administration, the complex is taken up by cells through an endocytotic mechanism, typically involving particle encapsulation in endosomal bodies.

The oligomer compound may also be administered in conjugated form with an arginine-rich peptide linked covalently to the 5' or 3' end of the oligomer. The peptide is typically 8-16 amino acids and consists of a mixture of arginine, and other amino acids including phenylalanine and cysteine. The use of arginine-rich peptide-PMO conjugates can be used to enhance cellular uptake of an oligomer (see, e.g., Moulton et al., *Bioconjug Chem*, 2004, 15(2): 290-299; Nelson et al., *Bioconjug Chem*, 2005, 16(4): 959-966).

In some instances, liposomes may be employed to facilitate uptake of the oligomers into cells (see, e.g., Williams, S. A., Leukemia 10(12): 1980-1989, 1996; Lappalainen et al., *Antiviral Res.*, 1994, 23:119; Uhlmann et al., *Chemical Reviews*, 1990, 90(4): 544-584). Hydrogels may also be used as vehicles for oligomer administration, for example, as described in WO 93/01286. Alternatively, the oligomers may be administered in microspheres or microparticles (see, e.g., Wu, G. Y. and Wu, C. H., *J. Biol. Chem.* 1987, 262:4429-4432). Alternatively, the use of gas-filled microbubbles complexed with the antisense oligomers can enhance delivery to target tissues, as described in U.S. Pat. No. 6,245,747.

In other examples, the requisite uptake properties of the oligomers of the present invention can be confirmed by a simple in vivo test, in which a labeled compound is administered to an animal (e.g., a mammal), and a body fluid sample, taken from the animal several hours after the oligomer is administered, is assayed, or the animal in whole or in part is imaged for the presence of the oligomer in a tumor cells of the animal.

In specific embodiments, the subject oligomer compounds are taken up preferentially by a tumor cell of a mammal than by a non-tumor or normal cell.

The oligomer compounds of the present invention suitably bind THOC4 and/or SSB1. Candidate oligomers can be tested for binding to one or both of the proteins using any suitable assay, including affinity assays. The assay can measure any one or more of dissociation rate constant ($k_d$) or association rate constant ($k_a$) or equilibrium binding constant ($K_D$) of an oligomer compound for THOC4 and/or SSB1. These constants are in some embodiments measured by a radiolabeled or fluorescently-labeled oligomer binding assay. This assay equilibrates a titration series of THOC4 or SSB1 with a minimal concentration of labeled oligomer. Polyacrylamide gel electrophoresis is used to determine the degree of binding to THOC4 or SSB1.

Affinity measurements can be determined by standard methodology for nucleic acid:protein interactions, for example, surface plasmon resonance (SPR) (Rich and Myszka *Curr. Opin. Biotechnol*, 2000, 11: 54; *Englebienne Analyst.* 1998, 123: 1599), isothermal titration calorimetry (ITC) or other kinetic interaction assays known in the art. In specific embodiments, the constants are measured by using surface plasmon resonance assays, e.g., using BIAcore surface plasmon resonance (BIAcore, Inc., Piscataway, N.J.) with immobilized THOC4 or SSB1 or a region thereof. Exemplary SPR methods are described in U.S. Pat. No. 7,229,619.

In specific embodiments, THOC4 binds the tumor-modulating oligomers with a $K_D$ that is at least two fold lower than the $K_D$ for the negative control oligomer Neg_C under the same conditions (e.g., under aqueous conditions comprising 10 mM Tris-HCl (pH 8.0) and 100 mM NaCl at 37° C.).

Exemplary conditions are described in Example 3. In representative examples, the oligomers bind THOC4, including hTHOC4, with a $K_D \leq$ about 60 nM, $\leq$ about 50 nM, $\leq$ about 40 nM, $\leq$ about 30 nM, $\leq$ about 20 nM or $\leq$ about 10 nM.

In some embodiments, an OB-fold protein binds the tumor-modulating oligomers with a $K_D$ that is at least two fold lower than the $K_D$ for the negative control oligomer Neg_C under the same conditions (e.g., under aqueous conditions comprising 10 mM Tris-HCl (pH 8.0) and 100 mM NaCl at 37° C.). Exemplary conditions are described in Examples 3 and 7. In representative examples, the oligomers bind an OB-fold protein, including SSB1 and SSB2, with a $K_D \leq$ about 10 nM, $\leq$ about 5 nM, $\leq$ about 4 nM, $\leq$ about 3 nM or $\leq$ about 2 nM. In illustrative examples of this type, SSB1 binds the tumor-modulating oligomers with a $K_D$ that is at least two fold lower than the $K_D$ for the negative control oligomer Neg_C under the same conditions (e.g., under aqueous conditions comprising 10 mM Tris-HCl (pH 8.0) and 100 mM NaCl at 37° C.). Exemplary conditions are described in Example 3. In representative examples, the oligomers bind SSB1, including hSSB1 and mSSB1, with a $K_D \leq$ about 10 nM, $\leq$ about 5 nM, $\leq$ about 4 nM, $\leq$ about 3 nM or $\leq$ about 2 nM. In other illustrative examples, SSB2 binds the tumor-modulating oligomers with a $K_D$ that is at least two fold lower than the $K_D$ for the negative control oligomer Neg_C under the same conditions (e.g., under aqueous conditions comprising 10 mM Tris-HCl (pH 8.0) and 100 mM NaCl at 37° C.). Exemplary conditions are described in Example 7. In representative examples, the oligomers bind SSB2, including hSSB2, with a $K_D \leq$ about 10 nM, $\leq$ about 5 nM, $\leq$ about 4 nM, $\leq$ about 3 nM or $\leq$ about 2 nM. Alternatively, or in addition, oligomer compounds of the present invention may be designed and/or identified using modeling in silico. For example, structural models may be used, which provide a representation of an OB-fold protein's three-dimensional secondary, tertiary, and/or quaternary amino acid residue structure. A structural model encompasses X-Ray crystal structures, NMR structures, theoretical protein structures, structures created from homology modeling, Protein Tomography models, and atomistic models built from electron microscopic studies. In specific embodiments, atomistic molecular dynamics (MD) simulations of OB-fold protein complexes with candidate oligomers can be used to identify compounds with promising affinity for OB-fold proteins and anti-tumor activity, as disclosed herein. Numerous MD simulations techniques are known in the art, representative examples of which are disclosed for example by Allison JR (2016, *Curr Opin Struct Biol*. 43:79-87), Ganesan et al. (2016, *Drug Discov Today* S1359-6446(16)30414-7) and Karplus et al. (2002, *Nature Structural Biology* 9: 646-652).

The oligomers of the present invention may block translocation of RNA, typically, mRNA from the nucleus to the cytoplasm of a tumor cell. Translocation of RNA to the nucleus can be measured, e.g., by nuclear translocation assays in which the emission of two or more fluorescently-labeled species is detected simultaneously. For example, the cell nucleus can be labeled with a known fluorophore specific for DNA, such as Hoechst 33342. The RNA can be directly or indirectly labeled, e.g., fluorescently-labeled antibody specific for RNA. The amount of RNA that translocates to or from the nucleus can be determined by determining the amount of a first fluorescently-labeled species, i.e., the nucleus, that is distributed in a correlated or anti-correlated manner with respect to a second fluorescently-labeled species, i.e., the RNA as described in U.S. Pat. No. 6,400,487, the contents of which are hereby incorporated by reference.

Oligomeric compounds of the present invention can inhibit proliferation of a tumor cell and often cause apoptosis or necrosis of a tumor cell. Cell proliferation may be assayed by exposing cells to a fluorescein labeled anti-PCNA antibody (e.g., PC-10, Santa Cruz Biotechnology) which binds to proliferating cell nuclear antigen (PCNA). Selected oligomers may be tested for an effect on proliferation on cell lines. From $2\times10^5$ to $2\times10^8$ cells may be plated in each well of a 96 well plate. Medium containing 1 µM to 10 µM of each oligomer may then be added to wells in triplicate. Minimally, a negative (no ligands) and a positive control are also performed. After 2 hours, FITC anti-PCNA may be added to the wells, incubated with the cells for 15 minutes and, after 3 washing steps, the level of fluorescence may be determined using a plate reader. The PCNA assay has already been used in cells and in tissues (Kulldorff et al. *J. Clin Epidemiology*, 2000, 53:875). Oligomeric compounds that inhibit proliferation may be tested on fresh tumor biopsies from cancer patients, including breast or prostate cancer patients. Small pieces of tumor biopsy may be plated in wells of a 96 well plate and the same assay as above repeated with each sample in duplicate. After the fluorescence is read, the samples may be assessed under a fluorescence microscope to confirm that the cells whose proliferation indeed is being affected are the cancer cells.

Apoptosis may be assayed using a cell membrane phosphatidyl serine binding dye (FITC Annexin V; alternative dyes such as Cy5.5 may also be used). Oligomeric compounds of the present invention may be tested for an effect on apoptosis on various cell lines. From $2\times10^5$ to $2\times10^8$ cells may be plated in each well of a 96 well plate and medium containing 1 µM to 10 µM of each oligomer is added to wells in triplicate. Minimally, a negative (no oligomer) and a positive (bcl2 reactive ligand) control are also performed. After 1.5 hours, FITC Annexin is added to the wells, incubated with the cells for 15 minutes and, after 3 washing steps, the level of fluorescence is determined using a plate reader. The assays may be demonstrated to be transferable from cells to tissues by using bcl-2 expressing cells and tissues from bcl-2 transgenic mice (Charles River). Ligands which induce apoptosis may be tested on fresh tumor biopsies from breast cancer patients. One advantage of using primary tissue biopsy is that the assay may be performed within two hours of tissue collection, i.e., before the tissue has begun showing the changes associated with ischemia. Small pieces of tumor biopsy may be plated in wells of a 96 well plate and the same assay as above is repeated with each sample in duplicate. After, the fluorescence is read, the samples may be stained with DAPI staining (Molecular Probes, Eugene Oreg.) and nuclear morphology may be assessed under a fluorescence microscope for nuclear condensation and fragmentation for confirmation. Alternatively, the classic TUNEL (terminal deoxynucleotidyl transferase mediated biotinylated deoxyuridine triphosphate nick end labeling) method to label DNA strand breaks may be used.

Techniques to detect necrosis include but are not limited to the classic techniques of DNA binding dyes such as propidium iodide or TOTO-3. Alternatively, a colorimetric methylthiazole tetrazolium (MTT) assay for the mitochondrial enzyme release can also be used to determine cell viability. In specific embodiments, cell viability is determined using the DNA binding dyes propidium iodide and TOTO-3. Conducting these assays in cell lines may enable one to distinguish between necrosis and apoptosis which will facilitate distinguishing oligomers have specific effects from oligomers which are broadly cytotoxic. This distinction may also be facilitated by performing necrosis and apoptosis assays in parallel. Selected oligomers may be tested for an effect on necrosis of the cell lines. From $2 \times 10^5$ to $2 \times 10^8$ cells may be plated in each well of a 96 well plate and medium containing 1 µM to 10 µM of each oligomer is added to wells in triplicate. Minimally, a negative (no oligomer) and a positive control are also performed. After 8 hours, propidium iodide or TOTO 3 is added to the wells, incubated with the cells for 15 minutes and after 3 washing steps, the level of fluorescence is determined using a fluorescent plate reader. Necrosis may be a difficult assay to transfer to tissue biopsies because it is generally assayed after at least 8 hours and there is a lot of necrosis due to ischemia in tissue biopsies after such an interval providing a high background. To overcome this problem, human biopsy tissue may be transplanted into nude mice, thereby preventing ischemia induced necrosis during the 8 hour assay period. To insure that growth in the nude mouse does not alter the tumor, a tumor, grown in a nude mouse for 1 month, may be explanted and tested in the short term apoptosis and proliferation. The tumor may also be viewed histologically and compared with the fresh tumor explant to assess differences. The ligands which bind to the same target and induce necrosis in 50% of the cases may be injected into the tumor in the animal, collected after 8 hours, and stained with propidium iodide. Histological examination may reveal that the tumor cells are undergoing necrosis while the other cells in the biopsy are not.

4. Oligomer Compositions and Applications

The oligomer compounds of the present invention function are useful as actives for inhibiting proliferation, survival or viability of a tumor cell, or for treating or preventing a cancer. The tumor cells can be treated in vivo or in vitro. Thus, the subject oligomers are useful, suitably in pharmaceutical compositions, for treating or preventing cancers. As such the present invention contemplates pharmaceutical compositions for treating, preventing and/or relieving the symptoms of a cancer, wherein the compositions comprise an effective amount of an oligomer of the invention and a pharmaceutically acceptable carrier.

The oligomeric compounds of the invention encompass any pharmaceutically acceptable salts, esters, or salts of such esters, or any other compound which, upon administration to an animal, typically a mammal including a human, is capable of providing (directly or indirectly) the biologically active metabolite or residue thereof. Accordingly, for example, the disclosure is also drawn to prodrugs and pharmaceutically acceptable salts of the oligomeric compounds of the invention, pharmaceutically acceptable salts of such prodrugs, and other bioequivalents. For nucleic acid oligomers, examples of pharmaceutically acceptable salts and their uses are further described in U.S. Pat. No. 6,287,860, which is incorporated herein in its entirety.

The compositions of the invention may also be admixed, encapsulated, conjugated or otherwise associated with other molecules, molecule structures or mixtures of compounds, as for example, liposomes, receptor-targeted molecules, oral, rectal, topical or other formulations, for assisting in uptake, distribution and/or absorption. Representative patent documents that teach the preparation of such uptake, distribution and/or absorption-assisting formulations include, but are not limited to, U.S. Pat. Nos. 5,108,921; 5,354,844; 5,416,016; 5,459,127; 5,521,291; 5,543,158; 5,547,932; 5,583,020; 5,591,721; 4,426,330; 4,534,899; 5,013,556; 5,108,921; 5,213,804; 5,227,170; 5,264,221; 5,356,633; 5,395,619; 5,416,016; 5,417,978; 5,462,854; 5,469,854; 5,512,295; 5,527,528; 5,534,259; 5,543,152; 5,556,948; 5,580,575; and 5,595,756, each of which is herein incorporated by reference.

The pharmaceutical compositions of the present invention may be administered in a number of ways depending upon whether local or systemic treatment is desired and upon the area to be treated. Administration may be topical (including ophthalmic and to mucous membranes including vaginal and rectal delivery), pulmonary, e.g., by inhalation or insufflation of powders or aerosols, including by nebulizer; intratracheal, intranasal, epidermal and transdermal), oral or parenteral. Parenteral administration includes intravenous, intraarterial, subcutaneous, intraperitoneal or intramuscular injection or infusion; or intracranial, e.g., intrathecal or intraventricular, administration. Oligomers with at least one 2'-O-methoxyethyl modification are believed to be particularly useful for oral administration. Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful.

Pharmaceutical compositions of the present invention include, but are not limited to, solutions, emulsions, foams and liposome-containing formulations. The pharmaceutical compositions of the present invention may comprise one or more penetration enhancers, carriers, excipients or other active or inactive ingredients.

One of skill in the art will recognize that pharmaceutical compositions are routinely designed according to their intended use, i.e. route of administration.

For example, preferred formulations for topical administration include those in which the oligonucleotides of the invention are in admixture with a topical delivery agent such as lipids, liposomes, fatty acids, fatty acid esters, steroids, chelating agents and surfactants. Preferred lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). Penetration enhancers and their uses are further described in U.S. Pat. No. 6,287,860, which is incorporated herein in its entirety. Surfactants and their uses are further described in U.S. Pat. No. 6,287,860, which is incorporated herein in its entirety.

Compositions for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. Preferred oral formulations are those in which oligonucleotides of the invention are administered in conjunction with one or more penetration enhancers surfactants and chelators. Preferred surfactants include fatty acids and/or esters or salts thereof, bile acids and/or salts thereof. Preferred bile acids/salts and fatty acids and their uses are further described in U.S. Pat. No. 6,287,860, which is incorporated herein in its entirety. Also preferred are combinations of penetration enhancers, for example, fatty acids/salts in combination with bile acids/salts. A particularly preferred combination is the sodium salt of lauric acid, capric acid and UDCA. Further penetration enhancers include polyoxyethylene-9-lauryl ether, polyoxyethylene-20-cetyl ether. Oligomeric compounds of the invention may be delivered orally, in granular form including sprayed dried particles, or complexed to form micro or nanoparticles. Nucleic acid oligomer complexing agents and their uses are further described in U.S. Pat. No. 6,287,860, which is incorporated herein in its entirety. Oral formulations for nucleic acid oligomers and their preparation are described in detail in U.S. application Ser. No. 09/108,673 (filed Jul. 1, 1998), Ser. No. 09/315,298 (filed May 20, 1999) and Ser. No. 10/071,822, filed Feb. 8, 2002, each of which is incorporated herein by reference in their entirety.

In another related embodiment, therapeutically effective combination therapies may comprise the use of two or more compositions of the invention wherein the multiple compositions are targeted to a single or multiple nucleic acid targets. Numerous examples of antisense oligomeric compounds are known in the art. Two or more combined compounds may be used together or sequentially.

Any oligomeric compound can be used in the compositions and methods of the present invention, provided that the compound is pharmaceutically active. A "pharmaceutically active" oligomer is in a form that results in a reduction, impairment, abrogation or prevention in the (i) formation; (ii) proliferation; (iii) survival; (iv) viability; or (v) maintenance of a tumor cell, and/or in the treatment and/or prevention of a cancer, including the prevention of incurring a symptom, holding in check such symptoms or treating existing symptoms associated with the cancer, when administered to an individual in need thereof.

Modes of administration, amounts of oligomer administered, and oligomer formulations, for use in the methods of the present invention, are routine and within the skill of practitioners in the art. Whether a cancer has been treated is determined by measuring one or more diagnostic parameters indicative of the course of the disease, compared to a suitable control. In the case of an animal experiment, a "suitable control" is an animal not treated with the oligomer compound, or treated with the pharmaceutical composition without the oligomer compound. In the case of a human subject, a "suitable control" may be the individual before treatment, or may be a human (e.g., an age-matched or similar control) treated with a placebo. In accordance with the present invention, the treatment of a cancer includes and encompasses without limitation: (1) impairing, abrogating, reducing, preventing, or arresting the development of, the (i) formation; (ii) proliferation; (iii) survival; (iv) viability; or (v) maintenance of a tumor cell in a patient; (2) treating a cancer (e.g., a primary or metastatic cancer) in a subject; (3) preventing a cancer (e.g., a primary or metastatic cancer) in a subject that has a predisposition to the cancer but has not yet been diagnosed with the cancer and, accordingly, the treatment constitutes prophylactic treatment of the cancer; or (iii) causing regression of a cancer (e.g., a primary or metastatic cancer).

The compositions and methods of the present invention are thus suitable for treating an individual who has been diagnosed with a cancer, who is suspected of having a cancer, who is known to be susceptible and who is considered likely to develop a cancer, or who is considered likely to develop a recurrence of a previously treated cancer. The cancer may be hormone receptor positive or hormone receptor negative. In some embodiments, the cancer is hormone receptor negative and is thus resistant to hormone or endocrine therapy. In some embodiments in which the cancer is breast cancer, the breast cancer (e.g., the non-breast CMC tumor cells) is hormone receptor negative (e.g., estrogen receptor (ER) negative and/or progesterone receptor (PR) negative).

The present invention also contemplates administering the oligomer compounds concurrently with at least one cancer therapy that inhibits the proliferation, survival or viability of tumor cells. The oligomer may be used therapeutically after the cancer therapy or may be used before the therapy is administered or together with the therapy. Accordingly, the present invention contemplates combination therapies, which employ an oligomer of the present invention and concurrent administration of an cancer therapy, non-limiting examples of which include radiotherapy, surgery, chemotherapy, hormone ablation therapy, pro-apoptosis therapy and immunotherapy.

4.1 Radiotherapy

Radiotherapies include radiation and waves that induce DNA damage for example, γ-irradiation, X-rays, UV irradiation, microwaves, electronic emissions, radioisotopes, and the like. Therapy may be achieved by irradiating the localized tumor site with the above described forms of radiations. It is most likely that all of these factors effect a broad range of damage DNA, on the precursors of DNA, the replication and repair of DNA, and the assembly and maintenance of chromosomes.

Dosage ranges for X-rays range from daily doses of 50 to 200 roentgens for prolonged periods of time (3 to 4 weeks), to single doses of 2000 to 6000 roentgens. Dosage ranges for radioisotopes vary widely, and depend on the half life of the isotope, the strength and type of radiation emitted, and the uptake by the neoplastic cells.

Non-limiting examples of radiotherapies include conformal external beam radiotherapy (50-100 Grey given as fractions over 4-8 weeks), either single shot or fractionated, high dose rate brachytherapy, permanent interstitial brachytherapy, systemic radio-isotopes (e.g., Strontium 89). In some embodiments the radiotherapy may be administered in combination with a radiosensitizing agent. Illustrative examples of radiosensitizing agents include but are not limited to efaproxiral, etanidazole, fluosol, misonidazole, nimorazole, temoporfin and tirapazamine.

4.2 Chemotherapy

Chemotherapeutic agents may be selected from any one or more of the following categories:

(i) antiproliferative/antineoplastic drugs and combinations thereof, as used in medical oncology, such as alkylating agents (for example cis-platin, carboplatin, cyclophosphamide, nitrogen mustard, melphalan, chlorambucil, busulphan and nitrosoureas); antimetabolites (for example antifolates such as fluoropyridines like 5-fluorouracil and tegafur, raltitrexed, methotrexate, cytosine arabinoside and hydroxyurea; anti-tumor antibiotics (for example anthracyclines like adriamycin, bleomycin, doxorubicin, daunomycin, epirubicin, idarubicin, mitomycin-C, dactinomycin and mithramycin); antimitotic agents (for example vinca alkaloids like vincristine, vinblastine, vindesine and vinorelbine and taxoids like paclitaxel and docetaxel; and topoisomerase inhibitors (for example epipodophyllotoxins like etoposide and teniposide, amsacrine, topotecan and camptothecin);

(ii) cytostatic agents such as antioestrogens (for example tamoxifen, toremifene, raloxifene, droloxifene and iodoxyfene), oestrogen receptor down regulators (for example fulvestrant), antiandrogens (for example bicalutamide, flutamide, nilutamide and cyproterone acetate), UH antagonists or LHRH agonists (for example goserelin, leuprorelin and buserelin), progestogens (for example megestrol acetate), aromatase inhibitors (for example as anastrozole, letrozole, vorazole and exemestane) and inhibitors of 5α-reductase such as finasteride;

(iii) agents which inhibit cancer cell invasion (for example metalloproteinase inhibitors like marimastat and inhibitors of urokinase plasminogen activator receptor function);

(iv) inhibitors of growth factor function, for example such inhibitors include growth factor antibodies, growth factor receptor antibodies (for example the anti-erbb2 antibody trastuzumab [Herceptin™] and the anti-erbb1 antibody cetuximab [C225]), farnesyl transferase inhibitors, MEK inhibitors, tyrosine kinase inhibitors and serine/threonine kinase inhibitors, for example other inhibitors of the epidermal growth factor family (for example other EGFR family tyrosine kinase inhibitors such as N-(3-chloro-4-fluorophenyl)-7-methoxy-6-(3-morpholinopropoxy)quinazolin-4-amine (gefitinib, AZD1839), N-(3-ethynylphenyl)-6,7-bis(2-methoxyethoxy)quinazolin-4-amine (erlotinib, OSI-774) and 6-acrylamido-N-(3-chloro-4-fluorophenyl)-7-(3-morpholinopropoxy)quinazoli-n-4-amine (CI 1033)), for example inhibitors of the platelet-derived growth factor family and for example inhibitors of the hepatocyte growth factor family;

(v) anti-angiogenic agents such as those which inhibit the effects of vascular endothelial growth factor, (for example the anti-vascular endothelial cell growth factor antibody bevacizumab [Avastin™], compounds such as those disclosed in International Patent Applications WO 97/22596, WO 97/30035, WO 97/32856 and WO 98/13354) and compounds that work by other mechanisms (for example linomide, inhibitors of integrin αvβ3 function and angiostatin);

(vi) vascular damaging agents such as Combretastatin A4 and compounds disclosed in International Patent Applications WO 99/02166, WO00/40529, WO 00/41669, WO01/92224, WO02/04434 and WO02/08213;

(vii) antisense therapies, for example those which are directed to the targets listed above, such as ISIS 2503, an anti-ras antisense; and (viii) gene therapy approaches, including for example approaches to replace aberrant genes such as aberrant p53 or aberrant GDEPT (gene-directed enzyme pro-drug therapy) approaches such as those using cytosine deaminase, thymidine kinase or a bacterial nitroreductase enzyme and approaches to increase patient tolerance to chemotherapy or radiotherapy such as multi-drug resistance gene therapy.

4.3 Immunotherapy

Immunotherapy approaches, include for example ex-vivo and in-vivo approaches to increase the immunogenicity of patient tumor cells, such as transfection with cytokines such as interleukin 2, interleukin 4 or granulocyte-macrophage colony stimulating factor, approaches to decrease T-cell anergy, approaches using transfected immune cells such as cytokine-transfected dendritic cells, approaches using cytokine-transfected tumor cell lines and approaches using anti-idiotypic antibodies. These approaches generally rely on the use of immune effector cells and molecules to target and destroy cancer cells. The immune effector may be, for example, an antibody specific for some marker on the surface of a malignant cell. The antibody alone may serve as an effector of therapy or it may recruit other cells to actually facilitate cell killing. The antibody also may be conjugated to a drug or toxin (chemotherapeutic, radionuclide, ricin A chain, cholera toxin, pertussis toxin, etc.) and serve merely as a targeting agent. Alternatively, the effector may be a lymphocyte carrying a surface molecule that interacts, either directly or indirectly, with a malignant cell target. Various effector cells include cytotoxic T cells and NK cells.

4.4 Other Therapies

Examples of other cancer therapies include phototherapy, cryotherapy, toxin therapy or pro-apoptosis therapy. One of skill in the art would know that this list is not exhaustive of the types of treatment modalities available for cancer and other hyperplastic lesions.

It is well known that chemotherapy and radiation therapy target rapidly dividing cells and/or disrupt the cell cycle or cell division. These treatments are offered as part of the treating several forms of cancer, aiming either at slowing their progression or reversing the symptoms of disease by means of a curative treatment. However, these cancer treatments may lead to an immunocompromised state and ensuing pathogenic infections and thus the present invention also extends to combination therapies, which employ both an oligomeric compound of the invention, a cancer therapy and an anti-infective agent that is effective against an infection that develops or that has an increased risk of developing from an immunocompromised condition resulting from the cancer therapy. The anti-infective drug is suitably selected from antimicrobials, which include without limitation compounds that kill or inhibit the growth of microorganisms such as viruses, bacteria, yeast, fungi, protozoa, etc. and thus include antibiotics, amebicides, antifungals, antiprotozoals, antimalarials, antituberculotics and antivirals. Anti-infective drugs also include within their scope anthelmintics and nematocides. Illustrative antibiotics include quinolones (e.g., amifloxacin, cinoxacin, ciprofloxacin, enoxacin, fleroxacin, flumequine, lomefloxacin, nalidixic acid, norfloxacin, ofloxacin, levofloxacin, lomefloxacin, oxolinic acid, pefloxacin, rosoxacin, temafloxacin, tosufloxacin, sparfloxacin, clinafloxacin, gatifloxacin, moxifloxacin; gemifloxacin; and garenoxacin), tetracyclines, glycylcyclines and oxazolidinones (e.g., chlortetracycline, demeclocycline, doxycycline, lymecycline, methacycline, minocycline, oxytetracycline, tetracycline, tigecycline; linezolide, eperozolid), glycopeptides, aminoglycosides (e.g., amikacin, arbekacin, butirosin, dibekacin, fortimicins, gentamicin, kanamycin, meomycin, netilmicin, ribostamycin, sisomicin, spectinomycin, streptomycin, tobramycin), Q-lactams (e.g., imipenem, meropenem, biapenem, cefaclor, cefadroxil, cefamandole, cefatrizine, cefazedone, cefazolin, cefixime, cefmenoxime, cefodizime, cefonicid, cefoperazone, ceforanide, cefotaxime, cefotiam, cefpimizole, cefpiramide, cefpodoxime, cefsulodin, ceftazidime, cefteram, ceftezole, ceftibuten, ceftizoxime, ceftriaxone, cefuroxime, cefuzonam, cephaacetrile, cephalexin, cephaloglycin, cephaloridine, cephalothin, cephapirin, cephradine, cefinetazole, cefoxitin, cefotetan, azthreonam, carumonam, flomoxef, moxalactam, amidinocillin, amoxicillin, ampicillin, azlocillin, carbenicillin, benzylpenicillin, carfecillin, cloxacillin, dicloxacillin, methicillin, mezlocillin, nafcillin, oxacillin, penicillin G, piperacillin, sulbenicillin, temocillin, ticarcillin, cefditoren, SC004, KY-020, cefdinir, ceftibuten, FK-312, S-1090, CP-0467, BK-218, FK-037, DQ-2556, FK-518, cefozopran, ME1228, KP-736, CP-6232, Ro 09-1227, OPC-20000, LY206763), rifamycins, macrolides (e.g., azithromycin, clarithromycin, erythromycin, oleandomycin, rokitamycin, rosaramicin, roxithromycin, troleandomycin), ketolides (e.g., telithromycin, cethromycin), coumermycins, lincosamides (e.g., clindamycin, lincomycin) and chloramphenicol.

Illustrative antivirals include abacavir sulfate, acyclovir sodium, amantadine hydrochloride, amprenavir, cidofovir, delavirdine mesylate, didanosine, efavirenz, famciclovir, fomivirsen sodium, foscarnet sodium, ganciclovir, indinavir sulfate, lamivudine, lamivudine/zidovudine, nelfinavir mesylate, nevirapine, oseltamivir phosphate, ribavirin, rimantadine hydrochloride, ritonavir, saquinavir, saquinavir mesylate, stavudine, valacyclovir hydrochloride, zalcitabine, zanamivir, and zidovudine.

Non-limiting examples of amebicides or antiprotozoals include atovaquone, chloroquine hydrochloride, chloroquine phosphate, metronidazole, metronidazole hydrochloride, and pentamidine isethionate. Anthelmintics can be at least one selected from mebendazole, pyrantel pamoate, albendazole, ivermectin and thiabendazole. Illustrative antifungals can be selected from amphotericin B, amphotericin B cholesteryl sulfate complex, amphotericin B lipid complex, amphotericin B liposomal, fluconazole, flucytosine, griseofulvin microsize, griseofulvin ultramicrosize, itraconazole, ketoconazole, nystatin, and terbinafine hydrochloride. Non-limiting examples of antimalarials include chloroquine hydrochloride, chloroquine phosphate, doxycycline, hydroxychloroquine sulfate, mefloquine hydrochloride, primaquine phosphate, pyrimethamine, and pyrimethamine with sulfadoxine. Antituberculotics include but are not restricted to clofazimine, cycloserine, dapsone, ethambutol hydrochloride, isoniazid, pyrazinamide, rifabutin, rifampin, rifapentine, and streptomycin sulfate.

As noted above, the present invention encompasses co-administration of an oligomer compound in concert with an additional agent. It will be understood that, in embodiments comprising administration of the oligomer with other agents, the dosages of the actives in the combination may on their own comprise an effective amount and the additional agent(s) may further augment the therapeutic or prophylactic benefit to the patient. Alternatively, the oligomer and the additional agent(s) may together comprise an effective amount for preventing or treating the cancer. It will also be understood that effective amounts may be defined in the context of particular treatment regimens, including, e.g., timing and number of administrations, modes of administrations, formulations, etc. In some embodiments, the oligomeric compound and optionally the cancer therapy are administered on a routine schedule. Alternatively, the cancer therapy may be administered as symptoms arise. A "routine schedule" as used herein, refers to a predetermined designated period of time. The routine schedule may encompass periods of time which are identical or which differ in length, as long as the schedule is predetermined. For instance, the routine schedule may involve administration of the oligomer on a daily basis, every two days, every three days, every four days, every five days, every six days, a weekly basis, a monthly basis or any set number of days or weeks therebetween, every two months, three months, four months, five months, six months, seven months, eight months, nine months, ten months, eleven months, twelve months, etc. Alternatively, the predetermined routine schedule may involve concurrent administration of the oligomer compound and the cancer therapy on a daily basis for the first week, followed by a monthly basis for several months, and then every three months after that. Any particular combination would be covered by the routine schedule as long as it is determined ahead of time that the appropriate schedule involves administration on a certain day.

For any compound used in the treatment methods of the invention, the therapeutically effective dose can be estimated initially from cell culture assays. For example, a dose can be formulated in animal models to achieve a circulating concentration range that includes the IC50 as determined in cell culture (e.g., the concentration of an active agent, which achieves a half-maximal inhibition in proliferation of a tumor cell). Such information can be used to more accurately determine useful doses in humans.

Dosing is dependent on severity and responsiveness of the disease state to be treated, with the course of treatment lasting from several days to several months, or until a cure is effected or a diminution of the disease state is achieved. Optimal dosing schedules can be calculated from measurements of drug accumulation in the body of the patient. Persons of ordinary skill can easily determine optimum dosages, dosing methodologies and repetition rates. Optimum dosages may vary depending on the relative potency of individual oligomer compounds, and can generally be estimated based on $EC_{50}s$ found to be effective in in vitro and in vivo animal models. In general, dosage is from 0.01 µg to 100 g per kg of body weight, and may be given once or more daily, weekly, monthly or yearly. Persons of ordinary skill in the art can easily estimate repetition rates for dosing based on measured residence times and concentrations of the drug in bodily fluids or tissues. Following successful treatment, it may be desirable to have the patient undergo maintenance therapy to prevent the recurrence of the disease state, wherein the oligonucleotide is administered in maintenance doses, ranging from 0.01 µg to 100 g per kg of body weight, once or more daily, weekly, monthly, or yearly. For double-stranded compounds, the dose must be calculated to account for the increased nucleic acid load of the second strand (as with compounds comprising two separate strands) or the additional nucleic acid length (as with self complementary single strands having double-stranded regions).

In some embodiments, and dependent on the intended mode of administration, the oligomer-containing compositions will generally contain about 0.000001% to 90%, about 0.0001% to 50%, or about 0.01% to about 25%, by weight of oligomer, the remainder being suitable pharmaceutical carriers or diluents etc. The dosage of the oligomer can depend on a variety of factors, such as mode of administration, the species of the affected subject, age, sex, weight and general health condition, and can be easily determined by a person of skill in the art using standard protocols. The dosages will also take into consideration the binding affinity of the oligomer to its target molecule (e.g., THOC4 or SSB1), its bioavailability and its in vivo and pharmacokinetic properties. In this regard, precise amounts of the agents for administration can also depend on the judgment of the practitioner. In determining the effective amount of the agents to be administered in the treatment or prevention of a cancer, the physician or veterinarian may evaluate the progression of the disease or condition over time. In any event, those of skill in the art may readily determine suitable dosages of the oligomer compound without undue experimentation. The dosage of the actives administered to a patient should be sufficient to effect a beneficial response in the patient over time such as impairment, abrogation or prevention in the formation, proliferation, survival, viability or maintenance of tumor cells, and/or in the treatment and/or prevention of a cancer. The dosages may be administered at suitable intervals to ameliorating the symptoms of the cancer. Such intervals can be ascertained using routine procedures known to persons of skill in the art and can vary depending on the type of active agent employed and its formulation. For example, the interval may be daily, every other day, weekly, fortnightly, monthly, bimonthly, quarterly, half-yearly or yearly.

Dosage amount and interval may be adjusted individually to provide plasma levels of the active agent, which are sufficient to maintain oligomer effects. Usual patient dosages for systemic administration range from 1-2000 mg/day, commonly from 1-250 mg/day, and typically from 10-150 mg/day. Stated in terms of patient body weight, usual dosages range from 0.02-25 mg/kg/day, commonly from 0.02-3 mg/kg/day, typically from 0.2-1.5 mg/kg/day. Stated in terms of patient body surface areas, usual dosages range from 0.5-1200 mg/m$^2$/day, commonly from 0.5-150 mg/m$^2$/day, typically from 5-100 mg/m$^2$/day.

Toxicity and therapeutic efficacy of the oligomer drugs can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit large therapeutic indices are preferred. The data obtained from these cell culture assays and animal studies can be used in formulating a range of dosage for use in human. The dosage of such compounds lies preferably within a range of circulating concentrations that include the ED50 with little or no toxicity. The dosage may vary within this range depending upon the dosage form employed and the route of administration utilized. The exact formulation, route of administration and dosage can be chosen by the individual physician in view of the patient's condition. (See for example Fingl et al., 1975, in "The Pharmacological Basis of Therapeutics", Ch. 1 p1).

Alternately, one may administer the oligomer compound in a local rather than systemic manner, for example, via injection of the compound directly into a tissue, which is preferably subcutaneous or omental tissue, often in a depot or sustained release formulation.

Furthermore, one may administer the oligomer compound in a targeted drug delivery system, for example, in a liposome coated with tissue-specific antibody. The liposomes will be targeted to and taken up selectively by the tissue.

In cases of local administration or selective uptake, the effective local concentration of the oligomer compound may not be related to plasma concentration.

In order that the invention may be readily understood and put into practical effect, particular preferred embodiments will now be described by way of the following non-limiting example.

EXAMPLES

Example 1

Tumor-Modulating Effects of Non-Targeting Oligomer Compounds

Modified RNA oligomer compounds were designed, which are not considered to target the transcriptome of tumor cells. The modifications include a phosphorothioate backbone (*) and a 2-O'-methyl modification (m), as indicated in TABLE 3, and are designated with the prefix 'LSA'. All sequences were ordered from Sigma-Aldrich (Castle Hill, NSW, Australia).

The oligomer compounds were transfected into the cancer cell lines HeLa, U2OS, LNCAP, MCF7, A549 and H460 at 100 nM or 50 nM final concentration using Lipofectamine 2000. This treatment resulted in the death of most cells by 20-36 hours, as shown by lower cell confluence and adherence of cells treated with the LSA compounds, as compared to cells treated with control compound (see, FIG. 1).

Figure 2:
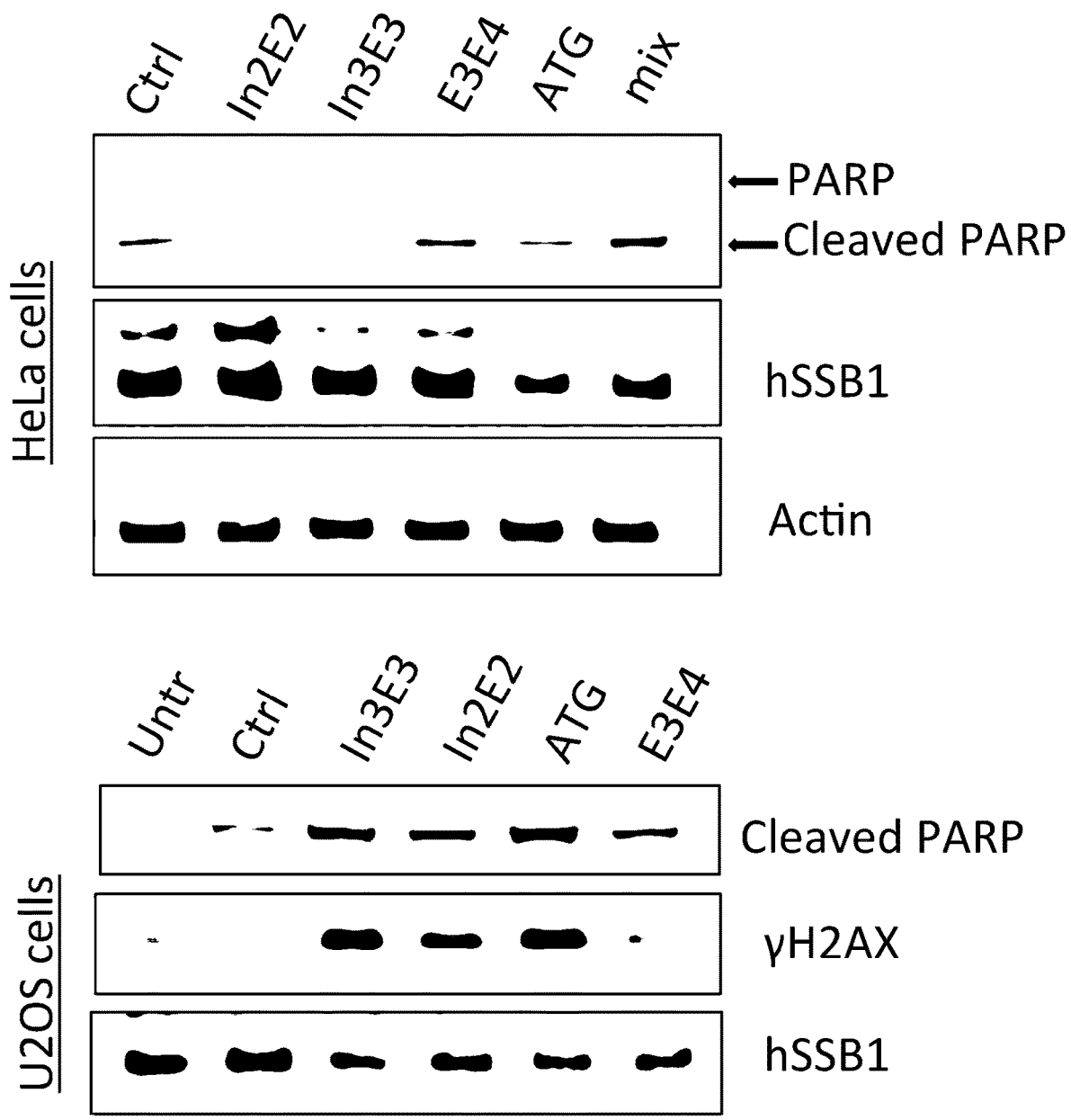
FIG. 2 is a photographic representation showing Western blots of HeLa and U2OS cells transfected with 100 nM of ctrl, In2E2LSA, In3E3LSA, E3E4LSA, ATGLSA oligomer compounds and a mix of all four LSA sequences (only HeLa cells). Cells were harvested at 24 hrs post transfection. PARP cleavage as marker of apoptosis was evident in LSA transfected cells, as was γH2AX induction as a marker for DNA damage. hSSB1 protein levels were decreased to various extents following LSA transfection. Actin was used as loading control.

Immunoblot analysis revealed a 40-50% reduction in hSSB1 polypeptide production of treated cells as well as PARP1 cleavage and increased H2AX phosphorylation (FIG. 2). PARP1 is cleaved during apoptosis and γH2AX specifically marks DNA breaks within the genome, confirming the presence of apoptosis and DNA damage, respectively, in cells treated with the non-targeting oligomers.

TABLE 3

| SEQ ID NO | OLIGO NAME | CONSOLIDATED OLIGO ID | OLIGOMER SEQUENCE (5'-3') |
|---|---|---|---|
| 282 | LSA_In2E2 | DKLS636117 | mG*mA*mG*mC*mC*mG*mU*mG*mG*mG*mU*mG*mA*mC*mU*mA*mC*mC*mC |
| 2 | LSA_ATG | DKLS230778 | mC*mA*mG*mA*mG*mG*mC*mA*mG*mC*mA*mG*mU*mA*mC*mG*mA*mC*mG*mG |
| 5 | LSA_In3E3 | DKLS394649 | mC*mC*mA*mG*mU*mG*mA*mG*mC*mC*mG*mG*mA*mC*mU*mU*mG*mC*mC*mU |
| 283 | LSA_E3E4 | DKLS612200 | mG*mA*mC*mU*mU*mC*mG*mC*mA*mU*mG*mG*mA*mA*mA*mC*mC*mA*mC |
| 281 | CTRL | DKLS329687 | mG*mA*mU*mC*mG*mA*mU*mC*mG*mA*mU*mC*mG*mA*mU*mC*mG*mA*mU*mC |

Sequence designations are as follows: m = 2'OMe-modified nucleoside, * = phosphorothioate (PS) internucleoside linkage. The oligomer names for the experiments described in Example 1 are shown (OLIGO NAME), together with their corresponding consolidated OLIGO ID and SEQ ID NO listed in TABLE 8.

Example 2

Comparison of Non-Targeting Oligomer Compounds and Antisense Compounds for Toxicity on Tumor Cells The non-targeting oligomers described in Example 1 were compared to antisense oligomers for tumor cell toxicity. The antisense oligomers were designed with the same backbone chemistry as the non-targeting oligomers and with specificity for targeting hSSB1 sequences. The sequences of the oligomers used for this study are shown in TABLE 4 in which non-targeting compounds are designated with the prefix 'LSA' and antisense compounds are designated with the prefix 'ASO'. All sequences were ordered from Sigma-Aldrich (Castle Hill, NSW, Australia).

Figure 3:
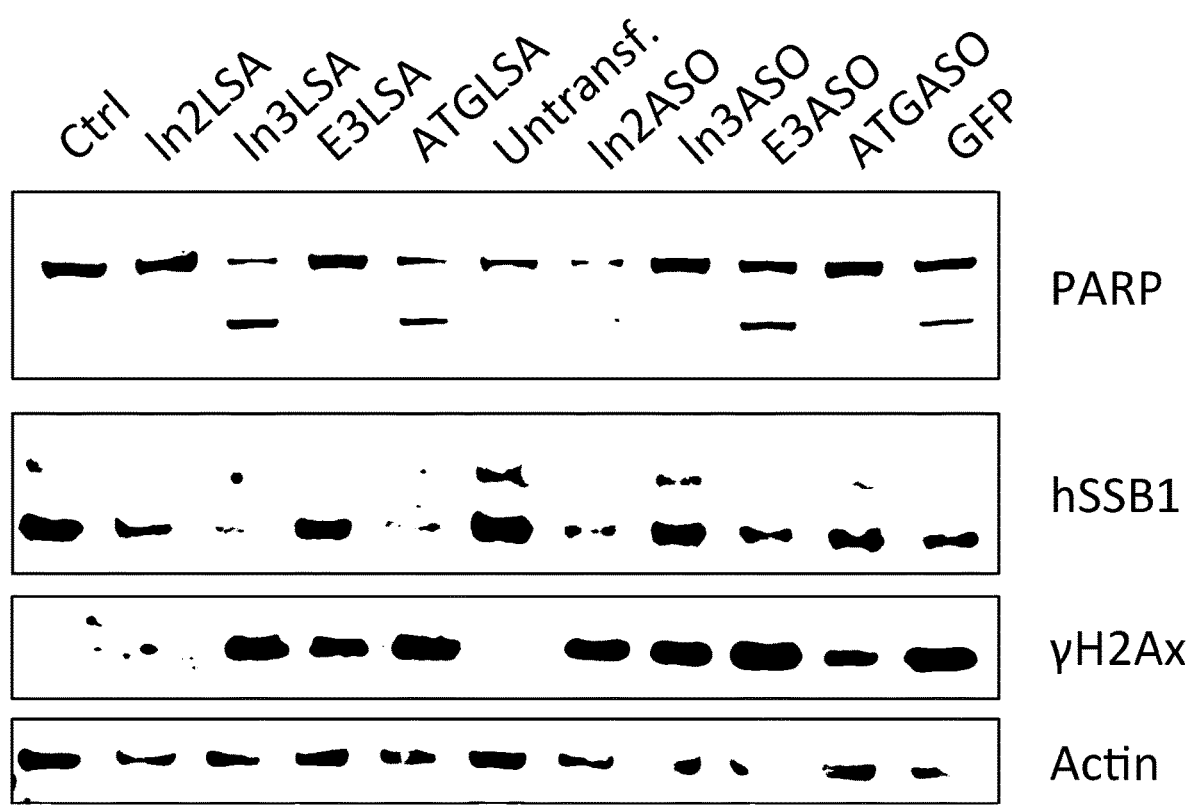
FIG. 3 is a photographic representation showing induction of apoptosis in U2OS cells transfected with LSAs and ASOs. Western blots show phosphorylation of H2AX that correlates with PARP cleavage, confirming induction of DNA damage and apoptosis in cells transfected with the toxic LSA/ASOs. hSSB1 protein levels are also depleted following transfection with the toxic LSA/ASOs. Actin was used as loading control.

As shown by PARP cleavage and H2AX induction, both non-targeting oligomers (LSAs) and antisense oligomers (ASOs) induced cell toxicity (FIG. 3). Notably, hSSB1 protein levels were also reduced in cells transfected with non-targeting oligomers and antisense oligomers.

Additional non-targeting oligomers and antisense oligomer compounds were designed and screened for toxicity in a panel of cancer cell lines using the IncuCyte kinetic live cell imaging system. These oligomers are shown in TABLE 5.

Figure 4:
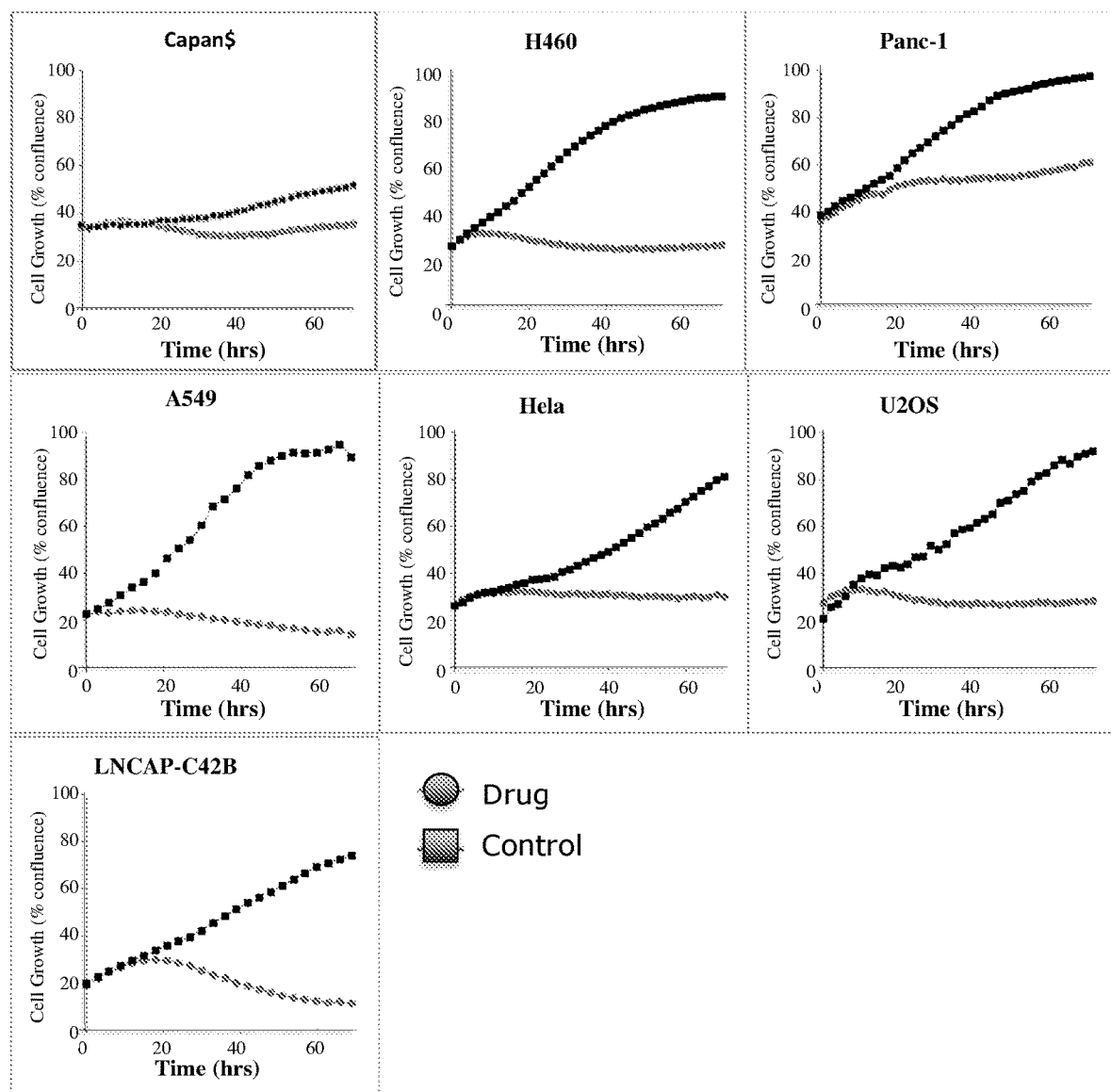
FIG. 4 is a graphic representation showing treatment with several cancer cell lines with the most effective LSAs, ATGLSA or In3LSA (drug) as compared to non-effective oligonucleotide (control). Cell growth was measured by IncuCyte over 72 hr.

Briefly, cells were seeded in microwell plates and 24 hr later transfected with LSA or ASO oligos (100 nM) and immediately loaded to an IncuCyte ZOOM system. Images were collected every 1-2 hr via phase-contrast microscopy for a period of 72 hrs. Data was analysed using IncuCyte ZOOM software. Cell proliferation was measured by monitoring the percentage cell confluence over time, as shown for representative oligonucleotides in FIG. 4. The 41 oligomer compounds listed in TABLE 5 were scored as 3=highly toxic, 2=moderately toxic, 1=slightly toxic and 0=non-toxic and this did not seem to depend on LSA or ASO orientation.

TABLE 4

| SEQ ID NO | OLIGO NAME | CONSOLIDATED OLIGO ID | OLIGOMER SEQUENCE (5'-3') |
|---|---|---|---|
| 282 | LSA_In2E2 | DKLS636117 | mG*mA*mG*mC*mC*mG*mU*mG*mG*mG*mU*mG*mA*mC*mC*mU*mA*mC*mC*mC |
| 2 | LSA_ATG | DKLS230778 | mC*mA*mG*mA*mG*mG*mC*mA*mG*mC*mA*mG*mU*mA*mC*mG*mA*mC*mG*mG |
| 5 | LSA_In3E3 | DKLS394649 | mC*mC*mA*mG*mU*mG*mA*mG*mC*mC*mG*mG*mA*mC*mU*mU*mG*mC*mC*mU |
| 283 | LSA_E3E4 | DKLS612200 | mG*mA*mC*mU*mU*mC*mG*mC*mA*mU*mG*mG*mG*mA*mA*mA*mC*mC*mA*mC |
| 281 | CTRL | DKLS329687 | mG*mA*mU*mC*mG*mA*mU*mC*mG*mA*mU*mC*mG*mA*mU*mC*mG*mA*mU*mC |
| 280 | ASO_In2E2 | DKLS364918 | mC*mU*mC*mG*mG*mC*mA*mC*mC*mC*mC*mA*mC*mU*mG*mG*mA*mU*mG*mG |
| 284 | ASO_In3E3 | DKLS860834 | mG*mG*mU*mC*mA*mC*mU*mC*mG*mG*mC*mC*mU*mG*mA*mA*mC*mG*mG*mA |
| 288 | ASO_E3E4 | DKLS409068 | mC*mU*mG*mA*mA*mG*mC*mG*mU*mA*mC*mC*mC*mU*mU*mU*mG*mG*mU*mG |
| 101 | ASO_ATG | DKLS421748 | mG*mU*mC*mU*mC*mC*mG*mU*mC*mG*mU*mC*mA*mU*mG*mC*mU*mG*mC*mC |
| 295 | ASO_GFP | DKLS827917 | mC*mA*mG*mC*mU*mC*mG*mU*mC*mC*mA*mU*mG*mC*mC*mG*mA*mG*mA*mG |

Sequence designations are as follows: m = 2'OMe-modified nucleoside, * = phosphorothioate (PS) internucleoside linkage.
The oligomer names for the experiments described in Example 2 are shown (OLIGO NAME), together with their corresponding consolidated OLIGO ID and SEQ ID NO listed in TABLE 8.

TABLE 5

| SEQ ID NO | OLIGO NAME | CONSOLIDATED OLIGO ID | OLIGOMER SEQUENCE (5'-3') | Type | Base # | GC (%) | Tm | AG (%) |
|---|---|---|---|---|---|---|---|---|
| 4 | Neg_C | DKLS525146 | mC*mU*mC*mA*mU*mC*mU*mC*mA*mC*mG*mA*mC*mC*mA*mC*mC*mC*mC* | LSA | 20 | 60 | 64.5 | 25% |
| 42 | NEG_C_GAP | DKLS848880 | mC*mU*mC*mA*mU*TCCTACCGACmA*mC*mC*mC | LSA | 20 | 60 | 35.5 | 25% |
| 294 | ASO_GFP_CT-5 | DKLS675388 | mC*mU*mG*mC*mC*mU*mC*mC*mC*mC*mG*mC*mC*mC*mC*mA*mA*mG | ASO | 20 | 60 | 64.6 | 25% |
| 302 | cdca3_L_In4E4-1 | DKLS649218 | mG*mA*mA*mC*mC*mC*mC*mA*mU*mC*mC*mC*mC*mA*mU*mU*mC*mC | ASO | 20 | 55 | 64.9 | 30% |
| 304 | FK-Aso_E2In2_3 | DKLS789189 | mG*mC*mC*mU*mA*mG*mU*mU*mC*mC*mU*mC*mC*mG*mU*mC*mA | LSA | 20 | 60 | 64.3 | 30% |
| 305 | ASO_GFP_CT-6 | DKLS651753 | mC*mA*mU*mC*mA*mU*mU*mC*mU*mU*mC*mU*mG*mA*mC*mU | ASO | 20 | 60 | 64 | 30% |
| 37 | LSA_In3E3_CT4 | DKLS727270 | mC*mG*mU*mC*mG*mC*mA*mU*mC*mU*mC*mC*mG*mA*mC*mU | LSA | 20 | 60 | 63.5 | 30% |
| 45 | LSA_In3E3_CT5 | DKLS786970 | mC*mG*mC*mG*mC*mU*mC*mA*mU*mC*mG*mC*mC*mC*mU | LSA | 20 | 70 | 69.2 | 35% |
| 198 | open_L_1 | DKLS659460 | mC*mU*mC*mG*mU*mU*mA*mU*mC*mU*mC*mC*mC*mA*mC | LSA | 20 | 55 | 61.9 | 25% |
| 277 | cdca3_L_In2E2-2 | DKLS832163 | mC*mU*mC*mC*mU*mU*mU*mU*mC*mG*mA*mC*mC*mU*mC | ASO | 20 | 60 | 64.1 | 30% |
| 278 | cdca3_A_ATG-3 | DKLS696616 | mC*mC*mC*mU*mG*mC*mG*mC*mC*mC*mA*mC*mC*mU*mC | ASO | 20 | 60 | 64.6 | 30% |
| 279 | ASO_ATG | DKLS370480 | mG*mU*mC*mU*mU*mC*mG*mC*mC*mU*mG*mC*mG*mC*mG | LSA | 20 | 65 | 68.9 | 45% |
| 280 | ASO_In2 | DKLS364918 | mC*mU*mC*mA*mG*mU*mC*mC*mA*mC*mU*mG*mG*mA*mU*mG*mG | ASO | 20 | 70 | 68.5 | 45% |
| 40 | In3LSA_GAP | DKLS316231 | mC*mA*mU*mG*mU*mG*A*G*C*C*G*A*C*T*mU*mG*mC*mU | LSA | 20 | 65 | 42.2 | 50% |
| 281 | Ctrl | DKLS329687 | mG*mA*mU*mC*mG*mA*mU*mC*mG*mA*mU*mC*mG*mA*mC*mC | LSA | 20 | 50 | 55.5 | 50% |
| 282 | LSA_In2E2 | DKLS636117 | mG*mG*mU*mG*mG*mG*mG*mG*mU*mG*mA*mU*mA*mC*mC | LSA | 20 | 70 | 68 | 55% |
| 283 | LSA_E3E4 | DKLS612200 | mG*mG*mA*mC*mU*mU*mU*mC*mA*mG*mG*mG*mA*mA*mC*mA*mC | ASO | 20 | 55 | 62.1 | 55% |
| 284 | ASO_In3 | DKLS860834 | mG*mG*mU*mU*mC*mU*mC*mG*mG*mU*mC*mG*mG*mA | LSA | 20 | 65 | 66.6 | 40% |
| 285 | FK-Aso_ATG_1 | DKLS331584 | mC*mG*mG*mU*mG*mC*mG*mG*mA*mC*mC*mG*mG*mU*mG | ASO | 20 | 75 | 70.8 | 45% |
| 286 | In3LSA_biotin | DKLS645702 | mC*mC*mC*mC*mC*mG*mC*mG*mU*mU*mU*mU*mC*mC*mU | LSA | 20 | 65 | 68.6 | 45% |
| 287 | In3LSA_FAM | DKLS645702 | mC*mC*mC*mC*mC*mG*mC*mG*mU*mU*mU*mU*mC*mC*mU | LSA | 20 | 65 | 68.6 | 45% |
| 38 | In3LSA_scr3_5 | DKLS748531 | mC*mC*mC*mC*mC*mG*mC*mG*mU*mA*mU*mC*mC*mU | LSA | 20 | 65 | 68.2 | 45% |
| 5 | LSA_In3E3 | DKLS394649 | mC*mC*mC*mC*mC*mG*mC*mG*mU*mU*mU*mU*mC*mC*mU | LSA | 20 | 65 | 68.6 | 45% |
| 288 | ASO_E3E4 | DKLS409068 | mC*mU*mG*mA*mA*mG*mU*mA*mC*mC*mG*mG*mU*mG | ASO | 20 | 55 | 67.8 | 45% |

TABLE 5-continued

| SEQ ID NO | OLIGO NAME | CONSOLIDATED OLIGO ID | OLIGOMER SEQUENCE (5'-3') | Type | Base # | GC (%) | Tm | AG (%) |
|---|---|---|---|---|---|---|---|---|
| 289 | FK-Aso_In2E3 | DKLS684387 | mG*mA*mU*mG*mA*mC*mC*mC*mU*mG*mC*mC*mA*mC*mG*mU*mA | ASO | 20 | 60 | 66.4 | 45% |
| 290 | LACZ_2224 | DKLS484655 | mC*mU*mC*mG*mG*mU*mG*mA*mU*mG*mA*mU*mG*mC*mG*mC*mG | LSA | 20 | 60 | 62.3 | 50% |
| 291 | ASO_GFP | DKLS771111 | mC*mA*mG*mG*mC*mU*mG*mC*mC*mA*mU*mG*mC*mC*mG*mA*mG | ASO | 20 | 65 | 66.9 | 50% |
| 292 | ASO_GFP_scr5 | DKLS820087 | mA*mC*mG*mG*mA*mU*mA*mC*mC*mU*mG*mC*mC*mG*mA*mA*mG | ASO | 20 | 65 | 67.7 | 50% |
| 293 | ASO_GFP_scr6 | DKLS817322 | mU*mA*mG*mG*mU*mG*mU*mC*mC*mU*mG*mA*mC*mG*mA*mA*mG | ASO | 20 | 60 | 65 | 50% |
| 295 | FK-Lsa_In2E3 | DKLS827917 | mC*mU*mA*mC*mU*mG*mG*mA*mC*mC*mC*mG*mC*mC*mA*mU | LSA | 20 | 60 | 65.8 | 55% |
| 296 | RevIn3LSA | DKLS843537 | mA*mG*mG*mC*mC*mA*mA*mT*mC*mT*mC*mA*mG*mA*mT*mG*mG | LSA | 20 | 65 |  | 55% |
| 297 | cdca3_A_In4E4-1 | DKLS859480 | mC*mU*mU*mG*mG*mG*mG*mC*mG*mU*mA*mC*mG*mA*mA*mG | ASO | 20 | 60 | 65.2 | 70% |
| 298 | FK-Lsa_E2In2_3 | DKLS371273 | mC*mG*mG*mA*mU*mG*mG*mG*mA*mA*mA*mC*mG*mU*mC*mA*mG*mU | LSA | 20 | 55 | 63.1 | 70% |
| 299 | cdca3_A_In2E2-2 | DKLS658030 | mG*mA*mG*mG*mG*mG*mG*mA*mG*mU*mC*mU*mG*mU*mG*mA*mG | ASO | 20 | 60 | 64.6 | 75% |
| 41 | In3LSA_CU | DKLS629290 | mC*mC*mA*mG*mG*mA*mG*mU*mU*mU*mG*mC*mC*mU*mU | LSA | 20 | 60 | 66.2 | 45% |
| 39 | In3LSA_scr3_4 | DKLS357796 | mC*mC*mC*mG*mG*mA*mA*mC*mA*mC*mG*mG*mC*mC*mU | LSA | 20 | 65 | 68.3 | 55% |
| 300 | Luc_2243 | DKLS506891 | mA*mC*mC*mC*mG*mA*mU*mA*mU*mU*mU*mC*mG*mA*mA*mG | ILSA | 20 | 50 | 58.3 | 60% |
| 301 | FK-Lsa_ATG-1 | DKLS665920 | mG*mG*mC*mG*mA*mU*mA*mU*mG*mG*mC*mG*mC*mC*mC | LSA | 20 | 75 | 72.4 | 60% |
| 3 | open_A_1 | DKLS170415 | mG*mU*mG*mC*mC*mA*mU*mG*mG*mA*mA*mU*mC*mC*mA*mG*mU*mG | LSA | 20 | 55 | 61 | 65% |
| 2 | LSA_ATG | DKLS230778 | mC*mA*mG*mA*mG*mG*mC*mC*mC*mA*mA*mU*mA*mC*mC*mG*mG | LSA | 20 | 65 | 66.4 | 70% |
| 303 | cdca3_L_ATG-3 | DKLS991101 | mG*mA*mG*mA*mC*mC*mA*mU*mC*mG*mU*mA*mG*mA*mG | LSA | 20 | 60 | 63.3 | 70% |

Sequence designations are as follows: m = 2'OMe-modified nucleoside, * = phosphorothioate (PS) internucleoside linkage.
The type of an individual oligomer (e.g., LSA or ASO) is shown, as well as its length (Base #), percentage guanosine-cytosine (GC) content, melting temperature (Tm) and percentage purine content (AG). Any detectable labels or reporter groups (e.g., biotin FAM) are indicated the OLIGO NAME.
The oligomer names for the experiments described in Example 2 are shown (OLIGO NAME), together with their corresponding consolidated OLIGO ID and SEQ ID NO listed in TABLE 8.

Example 3

Oligomer Compounds Bind to SSB1 and THOC4

Biotinylated non-targeting compound, LSA-IN3E3, and a negative control oligomer compound, NEGC, were incubated with cellular lysates. Interacting proteins were extracted using streptavidin beads, which bind to the biotinylated compounds. The beads were washed and interacting proteins were separated by SDS-PAGE, stained with Coomassie R250 and bands were excised for mass spectrometry identification of trypsin-digested fragments. Among the proteins identified in the mass spectrometry analysis were the single strand DNA repair protein hSSB1, and the mRNA transport protein THOC4. THOC4 is a 32-kDa protein component of the TREX complex, the complex which couples mRNA transcription, processing and nuclear export. THOC4 contains an RNA Recognition Motif (RRM), a single-stranded RNA binding domain, which could potentially mediate the binding to the oligomer compounds described herein.

Figure 5:
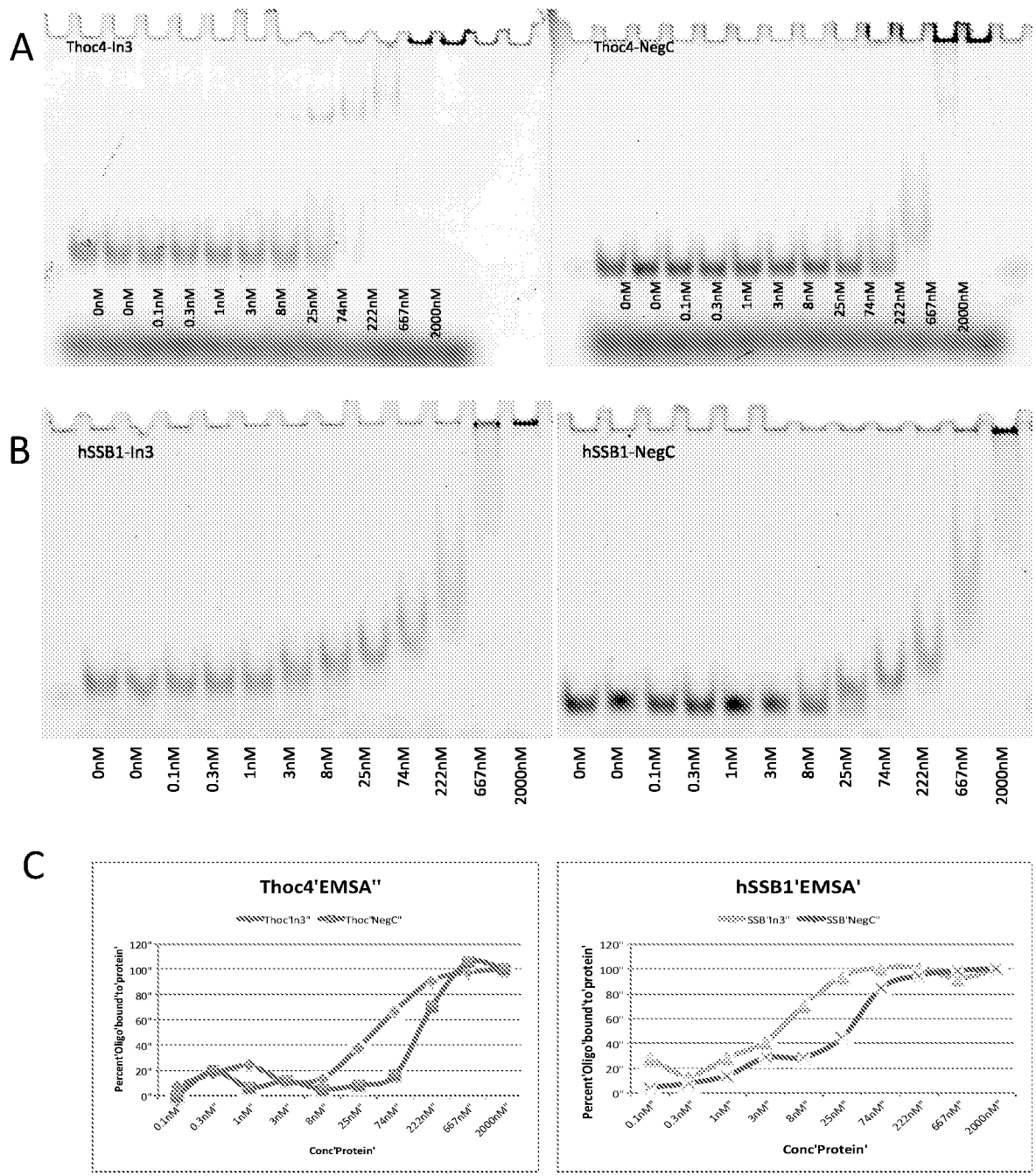
FIG. 5 is a photographic and graphic representation showing THOC4 and hSSB1 EMSAs. EMSAs showing increasing concentrations of THOC4 (A) and hSSB1 (B) proteins vs. 10 nmol of FAM-labeled LSA_In3E3 or negative control (Neg_C). The lower bands represent free unbound oligo, the higher bands and smear represent oligo bound to proteins, (C) quantification of triplicate EMSA experiments expressed as the percentage of oligo bound to the protein. Purified hSSB1 or THOC4 protein was incubated with 10 nmol of labeled oligo for 15 min at 37° C. in a buffer consisting of 10 mM Tris-HCl (pH8.0), 100 mM NaCl, 0.01% IGEPAL, 1 mM EDTA and 100 ng/µL BSA. Samples were separated by electrophoresis on a 10% PAGE gel in TBE buffer for 60 min at 80V at 4° C.

To confirm this interaction electromobility shift assays (EMSA) were performed using oligomer compounds that were effective at causing cell death (LSA_In3E3, Open_A_1, cdca3_L_ATG-3 and ASO_E3E4) and oligomer compounds that were relatively non-toxic in cells (Neg_C, LSA_In3E3_CT5=a mutated version of In3LSA, Open_L_1 and cdca3_A_ATG-3). The oligomeric compounds were labeled with FAM or Cy5, incubated with varying amounts of hSSB1 or THOC4, and bound and free oligomers were separated by native gel electrophoresis. Notably, both hSSB1 and THOC4 retarded the migration of the tumor-modulating oligomers with significantly higher affinity than the non-toxic oligomers, suggesting these two proteins may be involved in the observed phenotype (see, FIG. 5). The dissociation constants ($K_D$) for THOC4 are shown in TABLE 6, and those for hSSB1 are shown in TABLE 7 ($K_D$ values determined using non-linear regression in GraphPad Prism). Purified hSSB1 or THOC4 protein was incubated with 10 nmol of labeled oligo for 15 min at 37° C. in a buffer consisting of 10 mM Tris-HCl (pH8.0), 100 mM NaCl, 0.01% IGEPAL, 1 mM EDTA and 100 ng/μL BSA. Samples were separated by electrophoresis on a 10% PAGE gel in TBE buffer for 60 min at 80V at 4° C.

TABLE 6

| Oligomer | Label | Cell Death | KD (nM) |
| --- | --- | --- | --- |
| LSA_In3E3 | Fam | 3 | 81 |
| Neg_C | Fam | 0 | 150 |
| LSA_In3E3_CT5 | Fam | 0 | 125 |
| Open_A_1 | Fam | 3 | 52 |
| Open_L_1 | Fam | 0 | 104 |
| cdca3_A_ATG-3 | Fam | 0 | 134 |
| cdca3_L_ATG-3 | Cy5 | 3 | 58 |
| ASO_E3E4 | Cy5 | 2 | 70 |

TABLE 6 summarizes the results of triplicate EMSA experiments performed with THOC4 and eight different oligomer compounds. Dissociation constants for individual THOC4:oligomer interactions are shown ($K_D$, concentration of protein at which 50% of oligonucleotide is bound to the protein at equilibrium). As can be seen, THOC4 binds to tumor-modulating oligomers with a $K_D$ of about 50 to 80 nM, and to a negative control oligomer with a $K_D$ of 150 nM. $K_D$ values were determined by electrophoretic mobility shift assay (EMSA). Purified THOC4 protein was incubated with 10 nmol of labeled oligomer for 15 min at 37° C. in a buffer consisting of 10 mM Tris-HCl (pH8.0), 100 mM NaCl, 0.0% IGEPAL, 1 mM EDTA and 100 ng/μL BSA. Samples were separated by electrophoresis on a 10% PAGE gel in TBE buffer for 60 min at 80V at 4° C. $K_D$ values were determined using non-linear regression in GraphPad Prism by plotting the amount of free unbound oligo against protein concentration.

In a separate experiment, a GST-THOC4 derivative with improved solubility was found to THOC4 bind tumor-modulating oligomers with a $K_D$ of about 11 nM under the same conditions.

TABLE 7

| Oligomer | Label | Cell Death | $K_D$ (nM) |
| --- | --- | --- | --- |
| LSA_In3E3 | Fam | 3 | 3 |
| Neg_C | Fam | 0 | 9 |

TABLE 7 summarizes the results of triplicate EMSA experiments performed with hSSB1 and two different oligomer compounds. Dissociation constants for individual THOC4:oligomer interactions are shown ($K_D$, concentration of protein at which 50% of oligonucleotide is bound to the protein at equilibrium). As can be seen, hSSB1 binds to tumor-modulating oligomers with a $K_D$ of about 3 nM, and to a negative control oligomer with a $K_D$ of 9 nM. $K_D$ values were determined by electrophoretic mobility shift assay (EMSA). Purified hSSB1 protein was incubated with 10 nmol of labeled oligomer for 15 min at 37° C. in a buffer consisting of 10 mM Tris-HCl (pH 8.0), 100 mM NaCl, 0.0% IGEPAL, 1 mM EDTA and 100 ng/μL BSA. Samples were separated by electrophoresis on a 10% PAGE gel in TBE buffer for 60 min at 80V at 4° C. $K_D$ values were determined using non-linear regression in GraphPad Prism by plotting the amount of free unbound oligo against protein concentration.

Example 4

Oligomer Compounds Inhibit Cell Gene Expression and mRNA Translocation

Figure 6:
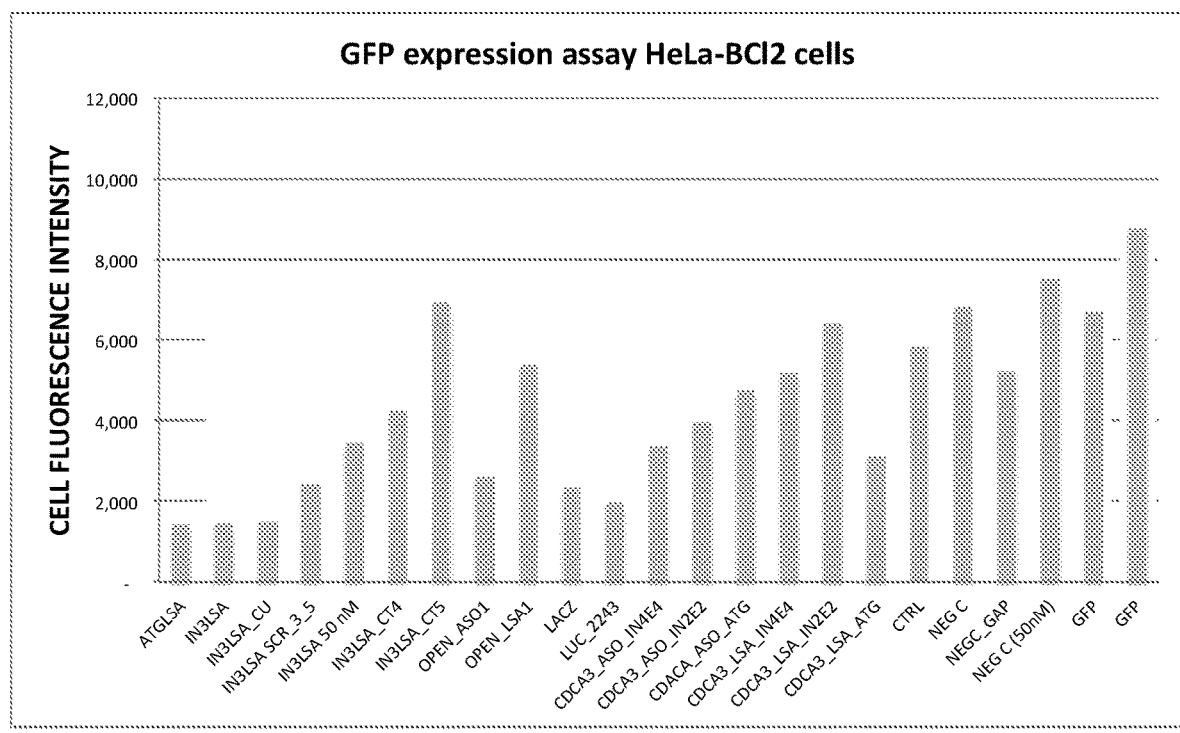
FIG. 6 is a graphic representation showing a GFP expression assay in HeLa-BCL2 cells transfected with ASOs or LSAs (100 nM). A correlation between oligomer compounds that induce cell death (ATGLSA, In3LSA, In3LSACU, etc.) and low GFP fluorescence is observed. Non death inducing oligonucleotides such as CTRL, NEGC, NEGC GAP, NEGC 50 nM, In3LSA_CT5, OPEN_LSA1, CDCA3_LSA_IN2E2 do not significantly affect GFP fluorescence as compared to cells transfected with GFP plasmid only (GFP). A reduction in GFP fluorescence indicates an inhibition of gene expression, consistent with inhibition of mRNA translocation.

Based on the involvement of THOC4 in transcription and mRNA export, a GFP reporter expression assay was performed in which apoptosis resistant HeLa-BCL2 cells were transfected (to avoid the bias of apoptosis) with 100 nM ASOs/LSAs using Lipofectamine 3000 (Life Technologies). Five hours later, the cells were transfected with the GFP reporter plasmid using Fugene 9 (Roche) and 20 hr post GFP transfection the fluorescence signal was analyzed using the high throughput Cytell cell imaging system. GFP plasmid only transfected cells were used as comparison (GFP). As shown in FIG. 6, non-targeting oligomers (LSAs) and antisense oligomers (ASOs) that are known to induce cell death also showed a dramatically reduced GFP fluorescence while non-toxic ASOs/LSAs did not affect GFP expression. This result suggests that the ASOs/LSAs that induce cell death do so by depleting components of the TREX complex leading to interference with global transcription. This in turn leads to DNA damage and cell death.

Figure 7:
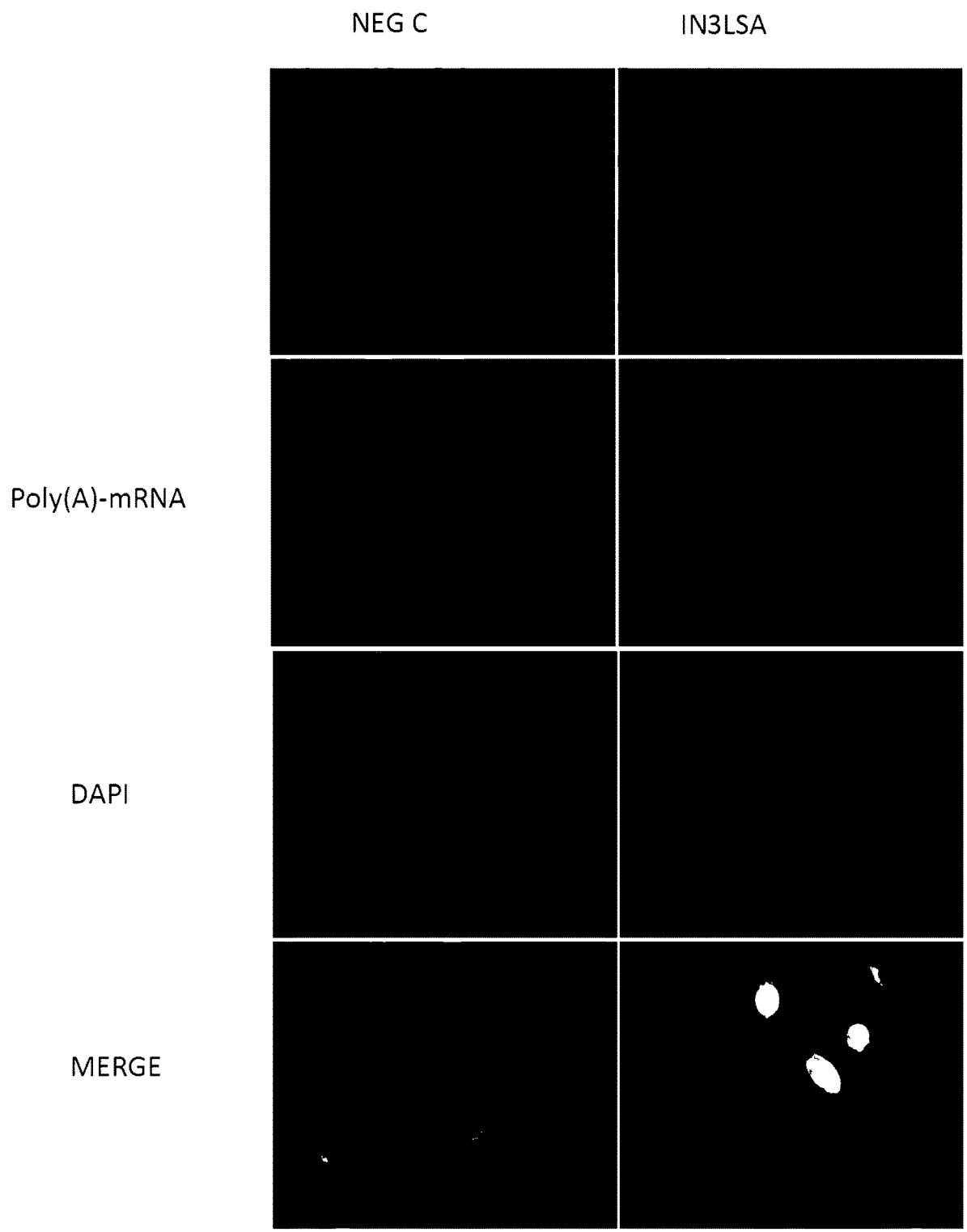
FIG. 7 is a photographic representation showing that IN3LSA oligomer compound inhibits polyA mRNA export from the nucleus. HeLa BCL2 cells were transfected with FAM labeled IN3LSA oligomer compound or NEGC oligonucleotide and mRNA FISH was performed at 24 hr post transfection. PolyA mRNA was stained in red and DAPI was used to stain the nuclei.

Global mRNA export was investigated in cells transfected with IN3LSA or NEGC by mRNA fluorescent in situ hybridization (FISH) experiments. The results show that nuclear export of polyA mRNA (stained in red), was inhibited in cells transfected with In3LSA but not NEGC (see, FIG. 7). This confirms that the TREX complex is inhibited by the In3LSA oligomer.

Example 5

High Content Screen of Candidate Oligomers for Identifying Essential Features

A high content screen was performed to identify the minimum length, chemistry, pyrimidine/purine content required for potency of tumor-modulating oligomer sequences of the present invention and for binding to THOC4 and/or hSSB1. A total of 305 different oligomers were screened using an Incell 2200 platform in HeLa and U2OS cells, using a Live-Dead protocol that combines the fluorescent stains Hoescht 33342 (cell permeable, stains live and dead cells) and Propidium Iodide (PI, cell impermeable, stains late apoptotic and dead cells). Cells were analyzed for: total cell count, apoptotic nuclei and propidium iodide (PI) staining, with results reported as the percentage of apoptotic (fragmented) nuclei and PI-positive cells (late-apoptotic or dead) measured at 24 hrs following treatment with oligomer compounds.

Binding of Oligomers to THOC4 or hSSB1 was performed using surface plasmon resonance (SPR), in which purified recombinant THOC4 or hSSB1 protein was coupled to the surface of the SPR chip, and oligomers were passed over the surface at a concentrations ranging from 2 nM to 16 μM in a buffer consisting of 20 mM Tris-HCl (pH 8.0), 100 mM NaCl and 0.01% IGEPAL.

The results from this high content screen are summarized in TABLE 8.

TABLE 8

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2′OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 1 | DKLS47 8030 | mC*mC*mA*mG*mU*mG*mA*mG*mC*mC*mG*mA*mC*mU*mG*mC*mC*mC*mC*mU | 20 | 68.6 | 65% | 45% | 3 | 1.00 | 1.00 |
| 2 | DKLS23 0778 | mC*mA*mG*mA*mG*mC*mC*mA*mG*mC*mU*mA*mC*mG*mC*mA*mC*mG*mG | 20 | 62.26 | 65% | 70% | 3 | 0.96 | 1.10 |
| 3 | DKLS17 0415 | mG*mU*mG*mG*mC*mA*mU*mG*mG*mA*mU*mC*mA*mU*mG*mG*mA*mG*mU*mG | 20 | 55.4 | 55% | 65% | 3 | 0.74 | 1.05 |
| 4 | DKLS52 5146 | mC*mU*mC*mA*mU*mU*mC*mC*mU*mA*mC*mC*mG*mA*mC*mA*mC*mC*mC*mC | 20 | 64.5 | 60% | 25% | 0 | 0.18 | 0.39 |
| 5 | DKLS39 4649 | mC*mC*mA*mG*mU*mG*mA*mG*mC*mC*mG*mA*mC*mU*mG*mC*mC*mC*mC*mU | 20 | 68.6 | 65% | 45% | 3 | 1.00 | 1.00 |
| 6 | DKLS50 6891 | U*C*U*C*C*A*G*C*G*U*G*C*G*C*A*U | 18 | 56.81 | 67% | 33% | 2 | 0.44 | 1.14 |
| 7 | DKLS37 1273 | U*A*C*C*G*C*G*U*G*C*G*A*C*C*C*U*C*U | 18 | 57.57 | 67% | 33% | 1 | 0.81 | 1.05 |
| 8 | DKLS65 8030 | U*C*U*C*C*A*G*C*A*U*G*U*G*C*C*A*U | 18 | 52.83 | 56% | 33% | 0 | 0.52 | 0.51 |
| 9 | DKLS69 6616 | mU*mC*mU*mC*mC*mA*mG*mC*mC*mG*mU*mG*mC*mC*mC*mA*mU | 18 | 56.81 | 67% | 33% | 0 | 1.12 | 0.79 |
| 10 | DKLS78 4557 | mU*mA*mC*mC*mG*mC*mG*mU*mG*mC*mG*mA*mC*mC*mC*mU*mC*mU | 18 | 57.57 | 67% | 33% | 2 | 0.49 | 0.69 |
| 11 | DKLS83 2163 | mU*mC*mU*mC*mC*mC*mA*mG*mC*mA*mU*mG*mU*mG*mC*mC*mA*mU | 18 | 52.83 | 56% | 33% | 0 | 0.33 | 0.31 |
| 12 | DKLS62 9224 | mG*mG*mU*mC*mG*mU*mU*mA*mA*mC*mU*mU*mU*mC*mU*mU*mU*mA | 20 | 37.75 | 35% | 40% | 2 | 0.47 | 0.97 |
| 13 | DKLS78 9189 | ZEN/CUCAUUCCUACCGACACCCC/ZEN | 20 | 54.3 | 60% | 25% | 0 | 0.03 | 0.09 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 14 | DKLS68 7764 | mU*mC*mA*mA*mG*mA*mA*mG*mA*mU*mG*mG*mC*mA*mU*mU*mU*mC*mU | 20 | 48.05 | 40% | 55% | 3 | 0.55 | 1.12 |
| 15 | DKLS68 7118 | mC*mU*mG*mU*mC*mC*mU*mC*mU*mA*mA*mC*mU*mA*mA*mA*mG*mU*mG*mU*mU*mA*mU*mA*mU*mA*mU*mA*mU*mA*mU*mA*mU*mA*mU*mA*mU*mA*mU*mA*mU*mA*mU*mA*mU*mA*mU*mA*mU*mA*mU*mA*mU*mA*mC | 23 | 49.33 | 35% | 61% | 2 | 0.51 | 1.21 |
| 16 | DKLS76 5774 | mC*mC*mA*mU*mU*mC*mU*mU*mC*mU*mU*mA*mU*mU*mA*mA*mU*mU*mA*mU*mU*mA*mU*mU*mA*mA | 23 | 37.83 | 22% | 52% | 3 | 0.97 | 1.93 |
| 17 | DKLS96 5031 | mG*mA*mG*mU*mA*mA*mA*mA*mC*mA*mU*mU*mU*mU*mG*mU*mG*mG*mA*mG*mU*mC | 23 | 50.62 | 43% | 57% | 3 | 0.64 | 1.35 |
| 18 | DKLS93 4835 | mC*mU*mG*mC*mC*mC*TAAGTAAAAGTGmU*mA*mA*mA*mC | 23 | 49.71 | 35% | 61% | 0 | 0.00 | -0.14 |
| 19 | DKLS65 6574 | mC*mC*mA*mU*mC*TGTAATTACAAAAmU*mU*mA*mA*mA | 23 | 40.25 | 22% | 52% | 0 | 0.01 | -0.03 |
| 20 | DKLS79 9151 | mG*mA*mG*mU*mA*AACATTCTGTGTGmG*mA*mG*mU*mC | 23 | 53.56 | 43% | 57% | 0 | 0.02 | 0.12 |
| 21 | DKLS35 4527 | mC*mA*mG*mC*mA*mG*mU*mC*mA*mU*mU*mC*mU*mA*mU*mC*mA*mU | 21 | 49.61 | 48% | 48% | 2 | 0.37 | 0.91 |
| 22 | DKLS48 4655 | mU*mG*mU*mU*mC*mU*mA*mU*mU*mG*mU*mG*mA*mU*mU | 18 | 37.22 | 33% | 39% | 2 | 0.22 | 0.43 |
| 23 | DKLS46 3500 | mU*mA*mA*mG*mC*mU*mA*mA*mC*mU*mU*mA*mU*mG*mU*mU | 18 | 36.59 | 33% | 39% | 2 | 0.32 | 0.74 |
| 24 | DKLS47 4224 | mG*mA*mG*mA*mA*mC*TmC*mC*mC*mG*mC | 15 | 58.73 | 73% | 53% | 2 | 0.14 | 0.23 |
| 25 | DKLS37 0480 | mU*mC*mA*mU*mA*mU*mU*mU*mU*mC*mU*mC*mA*mU*mC*mG*mU | 20 | 38.69 | 40% | 30% | 2 | 0.34 | 0.69 |
| 26 | DKLS33 1584 | mU*mU*mC*mA*mU*mC*mA*mU*mC*mC*mA*mC*mC*mU*mU*mU*mA*mG | 20 | 38.53 | 35% | 30% | 0 | 0.15 | 0.48 |
| 27 | DKLS69 3540 | mG*mG*mC*mG*mA*mA*mU*mG*mA*mU*mG*mA*mC*mU*mC*mU*mU*mU*mA | 20 | 47.45 | 45% | 50% | 1 | 0.89 | 1.64 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 28 | DKLS68 7192 | mU*mC*mU*mG*mA*mU*mC*mU*mU*mC*mA*mC*mA*mA*mU*mG | 20 | 50.52 | 50% | 35% | 2 | 0.76 | 1.08 |
| 29 | DKLS68 4387 | mU*mG*mU*mU*mA*mU*mU*mU*mG*mU*mG*mU*mC*mC*mU*mU | 20 | 42.92 | 40% | 30% | 1 | 0.87 | 1.38 |
| 30 | DKLS95 1212 | mG*mG*mG*mA*mC*mC*mG*mG*mC*mC*mU*mG*mG*mU*mC*mA*mU | 20 | 64.09 | 75% | 55% | 0 | 1.35 | 2.13 |
| 31 | DKLS48 1254 | mC*mA*mC*mG*mC*mA*mU*mG*mA*mU*mU*mU*mA*mU*mC*mA*mU | 21 | 44.02 | 38% | 52% | 3 | 0.46 | 1.10 |
| 32 | DKLS49 1049 | mG*mC*mU*mC*mC*mA*mU*mG*mC*mA*mU*mG*mC*mU*mU*mC | 20 | 56.03 | 60% | 30% | 2 | 0.26 | 0.65 |
| 33 | DKLS46 6380 | mG*mC*mU*mC*mA*mC*mA*mU*mG*mU*mG*mC*mU*mG*mU*mC | 20 | 57.41 | 55% | 65% | 1 | 0.98 | 2.62 |
| 34 | DKLS68 7764 | mA*mC*mA*mU*mC*mU*mU*mA*mC*mA*mC*mA*mU*mU*mG*mU*mU*mA | 22 | 46.82 | 41% | 50% | 3 | 0.75 | 1.47 |
| 35 | DKLS68 7118 | mA*mC*mA*mU*mG*mU*mU*mU*mC*mU*mG*mA*mC*mA*mC*mU*mU*mG*mU*mU*mA | 22 | 51.67 | 50% | 45% | 3 | 0.72 | 1.70 |
| 36 | DKLS48 1254 | mA*mG*mG*mC*mA*mA*mG*mU*mC*mC*mG*mG*mC*mC*mU*mG*mG | 20 | 63.22 | 65% | 55% | 3 | 0.76 | 0.82 |
| 37 | DKLS72 7270 | mG*mG*mU*mG*mU*mC*mA*mU*mC*mC*mG*mG*mC*mU*mA*mC*mU | 20 | 50.65 | 60% | 30% | 1 | 0.21 | 0.80 |
| 38 | DKLS74 8531 | mC*mC*mC*mA*mU*mC*mC*mC*mG*mG*mU*mG*mU*mC*mC*mU | 20 | 60.77 | 65% | 45% | 3 | 0.43 | 0.75 |
| 39 | DKLS35 7796 | mC*mC*mC*mG*mU*mG*mU*mG*mC*mC*mA*mU*mA*mC*mG*mU | 20 | 62.99 | 65% | 55% | 3 | 0.66 | 0.77 |
| 40 | DKLS31 6231 | mC*mC*mA*mU*mU*GAGCCGGACTmU*mG*mC*mU | 20 | 58.27 | 65% | 45% | 1 | -0.10 | 0.55 |
| 41 | DKLS62 9290 | mC*mC*mA*mG*mU*mA*mC*mU*mG*mC*mU*mU*mG*mC*mC*mU | 20 | 59.66 | 60% | 45% | 2 | 0.54 | 0.97 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 42 | DKLS84 8880 | mC*mU*mC*mA*mU*TCCTACCGACmA*mC*mC*mC | 20 | 53.93 | 60% | 25% | 0 | -0.10 | 0.56 |
| 43 | DKLS64 4620 | mCmCmAmGmUmGmAmGmCmCmGmGmAmCmCmUmGmCmCmU | 20 | 60.82 | 65% | 45% | 0 | -0.14 | 0.03 |
| 44 | DKLS62 1499 | mC*mC*mA*mGmUmGmAmGmCmCmGmGmAmCmCmUmGmC*mC*mU | 20 | 60.82 | 65% | 45% | 2 | -0.13 | 0.12 |
| 45 | DKLS78 6970 | mC*mG*mC*mG*mU*mC*mU*mC*mA*mC*mA*mC*mU*mC*mC*mG*mC*mC*mC*mU | 20 | 57.23 | 70% | 30% | 1 | 0.03 | 0.46 |
| 46 | DKLS41 5889 | mC*mG*mC*mG*mU*CACTCGCACTmC*mG*mC*mC*mU | 20 | 57.6 | 70% | 30% | 0 | -0.16 | 0.05 |
| 47 | DKLS99 1101 | ZEN/CCAGTGAGCCGGACUUGCCU/ZEN | 20 | 60.8 | 65% | 45% | 0 | -0.13 | 0.17 |
| 48 | DKLS64 9218 | ZEN/CAGAGGCAGCAGUACGACGG/ZEN | 20 | 62.3 | 65% | 70% | 0 | -0.09 | 0.15 |
| 49 | DKLS65 1753 | ZEN/GUGCAUGGAAUCACGGAGUG/ZEN | 20 | 55.4 | 55% | 65% | 0 | -0.12 | 0.07 |
| 50 | DKLS66 5920 | ZEN/CACGUACCUUAGUGCCUCAC/ZEN | 20 | 51.6 | 55% | 35% | 0 | -0.15 | 0.07 |
| 51 | DKLS67 5388 | mU*mU*mG*mA*mC*mA*mG*mU*mU*mA*mA*mU*mU*mC*mC*mA*mU*mU*mU*mC | 20 | 40.22 | 35% | 45% | 1 | 0.15 | 0.89 |
| 52 | DKLS65 9460 | mG*mC*mC*mA*mC*mC*mC*mG*mU*mC*mG*mU*mC*mC*mG*mC*mA*mG*mA | 20 | 57.41 | 65% | 45% | 3 | 0.89 | 1.65 |
| 53 | DKLS64 9547 | mC*mC*mG*mG*mG*mG*mU*mC*mC*mU*mC*mC*mG*mU*mA*mC*mU*mC*mG*mA | 20 | 60.62 | 65% | 45% | 2 | 0.85 | 1.55 |
| 54 | DKLS64 6683 | mG*mC*mC*mC*mG*mU*mC*mU*mG*mC*mG*mC*mC*mC*mA*mU*mA*mC*mU*mA | 20 | 59.55 | 65% | 45% | 2 | 0.85 | 0.98 |
| 55 | DKLS67 9059 | mG*mG*mG*mC*mG*mC*mC*mU*mC*mU*mC*mC*mC*mG*mC*mA*mC*mU*mG*mA*mU | 20 | 61.91 | 65% | 45% | 1 | 0.37 | 0.85 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 56 | DKLS65 6105 | mG*mG*mC*mA*mC*mG*mU*mC*mC*mG*mC*mC*mA*mU*mC*mA*mU*mG*mU | 20 | 57.42 | 65% | 45% | 3 | 0.23 | 0.73 |
| 57 | DKLS42 0640 | mC*mC*mU*mC*mU*mC*mU*mG*mC*mU*mU*mC*mC*mU*mG*mC*mC*mC*mU | 20 | 56.14 | 65% | 15% | 0 | 0.03 | 0.48 |
| 58 | DKLS37 4580 | mC*mC*mU*mG*mU*mG*mU*mG*mC*mU*mC*mC*mC*mU*mG*mC*mC*mC*mU | 20 | 55.81 | 65% | 15% | 0 | 0.12 | 0.68 |
| 59 | DKLS46 3357 | mC*mC*mU*mG*mU*mC*mA*mG*mG*mC*mC*mC*mG*mU*mC*mA*mC*mC*mU | 20 | 58 | 65% | 30% | 2 | 0.39 | 0.95 |
| 60 | DKLS45 9520 | mC*mC*mA*mC*mC*mU*mG*mA*mG*mA*mC*mC*mC*mU*mC*mC*mC*mC*mU | 20 | 59.67 | 65% | 30% | 0 | 0.03 | 0.63 |
| 61 | DKLS39 9970 | mC*mC*mC*mA*mC*mA*mA*mA*mG*mA*mA*mG*mA*mA*mA*mC*mA*mA*mU | 20 | 52.81 | 50% | 50% | 2 | 0.30 | 0.64 |
| 62 | DKLS45 9014 | mC*mC*mC*mA*mC*mA*mA*mG*mG*mA*mA*mC*mC*mU*mU*mC*mC*mC*mU | 20 | 52.66 | 55% | 40% | 1 | 0.26 | 0.55 |
| 63 | DKLS44 7399 | mC*mU*mA*mA*mA*mA*mG*mU*mC*mC*mU*mG*mA*mC*mC*mU*mC*mC*mU | 20 | 50.39 | 50% | 45% | 2 | 1.22 | 1.22 |
| 64 | DKLS71 2428 | mC*mC*mA*mC*mG*mG*mA*mG*mC*mC*mC*mU*mU*mG*mG*mG*mC*mC*mG | 20 | 66.19 | 75% | 60% | 2 | 0.51 | 0.70 |
| 65 | DKLS44 4294 | mG*mC*mG*mG*mG*mG*mA*mU*mC*mU*mC*mA*mA*mU*mC*mU*mC*mC*mU | 20 | 59.03 | 60% | 60% | 0 | 1.78 | 1.58 |
| 66 | DKLS43 8994 | mG*mC*mC*mG*mG*mA*mA*mA*mC*mC*mC*mA*mG*mU*mG*mC*mC*mC*mU | 20 | 61.26 | 65% | 60% | 2 | 1.11 | 1.03 |
| 67 | DKLS43 7053 | mC*mC*mA*mC*mG*mG*mA*mG*mC*mC*mC*mU*mG*mG*mU*mC*mC*mC | 19 | 60.94 | 68% | 47% | 3 | 0.90 | 0.68 |
| 68 | DKLS39 8126 | mC*mC*mC*mU*mG*mU*mG*mC*mC*mG*mA*mC*mG*mA*mU*mU*mG*mC | 18 | 58.46 | 67% | 50% | 3 | 0.87 | 0.67 |
| 69 | DKLS43 5532 | mC*mC*mC*mA*mG*mU*mG*mA*mG*mC*mC*mC*mC*mG*mA*mC*mU*mU*mG | 17 | 53.94 | 65% | 53% | 3 | 0.69 | 0.59 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 70 | DKLS42 8543 | mC*mC*mA*mG*mU*mG*mA*mG*mC*mC*mG*mG*mA*mC*mU | 16 | 52.31 | 63% | 50% | 3 | 0.38 | 0.40 |
| 71 | DKLS42 6690 | mC*mC*mA*mG*mU*mG*mA*mG*mC*mC*mG*mG*mA*mC*mU | 15 | 55.02 | 67% | 53% | 3 | -0.09 | 0.36 |
| 72 | DKLS42 6564 | mC*mC*mA*mG*mU*mG*mA*mG*mC*mC*mG*mG*mA*mC | 14 | 54.85 | 71% | 57% | 2 | 0.08 | 0.35 |
| 73 | DKLS42 1748 | mC*mC*mA*mG*mU*mG*mA*mG*mC*mC*mG*mG*mA | 13 | 50.01 | 69% | 62% | 2 | 0.08 | 0.53 |
| 74 | DKLS39 7701 | mC*mC*mA*mG*mU*mG*mA*mG*mC*mC*mG*mG | 12 | 47.78 | 75% | 58% | 0 | 0.00 | 0.24 |
| 75 | DKLS79 1575 | mC*mC*mA*mG*mU*mG*mA*mG*mC*mC*mG | 11 | 40.65 | 73% | 55% | 0 | -0.03 | 0.15 |
| 76 | DKLS37 8257 | mC*mC*mA*mG*mU*mG*mA*mG*mC*mC | 10 | 36.94 | 70% | 50% | 0 | -0.01 | 0.11 |
| 77 | DKLS18 7090 | mC*mC*mA*mG*mU*mG*mA*mG*mC | 9 | 28.8 | 67% | 56% | 0 | -0.06 | 0.09 |
| 78 | DKLS35 4527 | mC*mC*mA*mG*mU*mG*mA*mG | 8 | 16 | 63% | 63% | 0 | -0.05 | 0.09 |
| 79 | DKLS50 3590 | mC*mA*mG*mU*mG*mA*mG*mC*mC*mG*mG*mA*mC*mU*mG*mC*mC*mC*mU | 19 | 58.45 | 63% | 47% | 3 | 0.87 | 0.92 |
| 80 | DKLS47 2247 | mA*mG*mU*mG*mA*mG*mC*mC*mG*mG*mA*mC*mU*mG*mC*mC*mC*mU | 18 | 58.56 | 61% | 50% | 3 | 0.84 | 0.84 |
| 81 | DKLS55 9250 | mG*mU*mG*mA*mG*mC*mC*mG*mG*mA*mC*mU*mG*mC*mC*mC*mU | 17 | 56.82 | 65% | 47% | 3 | 0.23 | 0.83 |
| 82 | DKLS93 1438 | mU*mG*mA*mG*mC*mC*mG*mG*mA*mC*mU*mG*mC*mC*mC*mU | 16 | 55.96 | 63% | 44% | 3 | 0.24 | 0.48 |
| 83 | DKLS67 8949 | mG*mA*mG*mC*mC*mG*mG*mA*mC*mU*mG*mC*mC*mC*mU | 15 | 54.8 | 67% | 47% | 3 | 0.45 | 0.40 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 84 | DKLS479801 | mA*mG*mC*mC*mG*mG*mA*mC*mU*mU*mG*mC*mC*mU | 14 | 52.41 | 64% | 43% | 2 | 0.09 | 0.30 |
| 85 | DKLS356102 | mG*mC*mC*mG*mG*mA*mU*mU*mU*mG*mC*mC*mU | 13 | 49.76 | 69% | 38% | 1 | 0.01 | 0.22 |
| 86 | DKLS308827 | mC*mC*mG*mG*mA*mC*mU*mU*mG*mC*mC*mU | 12 | 42.91 | 67% | 33% | 0 | 0.07 | 0.13 |
| 87 | DKLS418490 | mC*mG*mG*mA*mC*mU*mU*mG*mC*mC*mU | 11 | 37.39 | 64% | 36% | 0 | 0.01 | 0.09 |
| 88 | DKLS642581 | mG*mG*mA*mC*mU*mU*mG*mC*mC*mU | 10 | 33.12 | 60% | 40% | 0 | -0.01 | 0.07 |
| 89 | DKLS620877 | mG*mA*mC*mU*mU*mG*mC*mC*mU | 9 | 21.1 | 56% | 33% | 0 | -0.02 | |
| 90 | DKLS459520 | mA*mC*mU*mU*mG*mC*mC*mU | 8 | 14.2 | 50% | 25% | 0 | -0.02 | |
| 91 | DKLS748531 | mC*mA*mG*mU*mG*mA*mG*mC*mC*mG*mG*mA*mC*mU*mU*mG*mC*mC | 18 | 58.46 | 67% | 50% | 3 | 0.96 | 0.91 |
| 92 | DKLS712428 | mA*mG*mU*mG*mA*mG*mC*mC*mG*mG*mA*mC*mU*mU*mG*mC | 16 | 55.59 | 63% | 56% | 3 | 0.68 | 0.71 |
| 93 | DKLS316231 | mG*mU*mG*mA*mG*mC*mC*mG*mG*mA*mC*mU*mU*mG | 14 | 47.69 | 64% | 57% | 3 | 0.48 | 0.45 |
| 94 | DKLS399970 | mU*mG*mA*mG*mC*mC*mG*mG*mA*mC*mU*mU | 12 | 43.03 | 58% | 50% | 1 | 0.08 | 0.20 |
| 95 | DKLS308266 | mG*mA*mG*mC*mC*mG*mG*mA*mC*mU | 10 | 42.27 | 70% | 60% | 0 | -0.04 | 0.13 |
| 96 | DKLS307561 | mA*mG*mC*mC*mG*mG*mA*mC | 8 | 35.6 | 75% | 63% | 0 | -0.07 | 0.07 |
| 97 | DKLS300878 | CCAGUGAGCCGGACUUGCCU | 20 | 62.3 | 65% | 45% | 0 | -0.05 | 0.03 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 98 | DKLS29 2688 | mC*mA*mG*mA*mG*GCAGCAGTACmG*mA*mC*mG*mG | 20 | 59.84 | 65% | 70% | 2 | 0.00 | 0.20 |
| 99 | DKLS45 9014 | mCmAmGmAmGmCmAmGmCmAmGmUmAmGmUmAmCmGmG | 20 | 62.26 | 65% | 70% | 0 | -0.02 | 0.10 |
| 100 | DKLS28 6198 | mC*mA*mG*mAmGmCmAmGmCmAmGmUmAmCmGmA*mC*mG*mG | 20 | 62.26 | 65% | 70% | 3 | -0.02 | 0.17 |
| 101 | DKLS42 1748 | mG*mU*mC*mU*mC*mC*mG*mA*mU*mG*mU*mC*mG*mC*mC | 20 | 53.78 | 65% | 30% | 1 | 0.33 | 0.64 |
| 102 | DKLS42 6564 | mG*mU*mC*mU*mC*CGTCGTCATGmC*mU*mG*mC*mC | 20 | 59.67 | 65% | 30% | 0 | -0.03 | 0.16 |
| 103 | DKLS42 6690 | C*C*A*G*U*G*A*G*C*C*G*A*C*U*G*C*U*U | 20 | 62.3 | 65% | 45% | 3 | 1.06 | 0.99 |
| 104 | DKLS42 8543 | mC*mA*mG*mA*mG*mC*mA*mG*mC*mA*mG*mU*mA*mC*mG*mA*mC*mG*mA*mC*mG*mA*mC*mG*mC*mC*mA*mG*mU*mC | 30 | 74.74 | 67% | 70% | 3 | 1.21 | 1.89 |
| 105 | DKLS43 5532 | mC*mA*mG*mA*mG*mC*mA*mG*mC*mA*mG*mU*mA*mC | 15 | 53.33 | 60% | 67% | 2 | 0.25 | 0.36 |
| 106 | DKLS39 8126 | mC*mA*mG*mA*mG*mC*mA*mG*mC*mA*mG*mC | 10 | 42.41 | 70% | 70% | 0 | 0.11 | 0.17 |
| 107 | DKLS43 7053 | mG*mG*mA*mG*mC*mC*mC*mC*mG*mG*mA*mC*mA*mC*mG*mG*TmC*mA*mC*mA | 20 | 66 | 65% | 70% | 2 | 0.78 | 0.99 |
| 108 | DKLS39 4649 | mG*mG*mG*mG*mA*mG*mC*mC*mC*mC*mA*mC*mA*mC*mG*mG*mC*mG*TmA*mC*mG*mA | 20 | 65.27 | 65% | 70% | 1 | 1.64 | 1.60 |
| 109 | DKLS89 1943 | mG*mA*mG*mC*mC*mG*mA*mA*mC*mG*mA*mC*mG*mG*mA*mC*mC*mC*mA | 19 | 65.1 | 68% | 74% | 3 | 0.68 | 0.84 |
| 110 | DKLS89 4584 | mG*mC*mG*mG*mA*mA*mA*mC*mC*mG*mG*mA*mC*mC*mG*mA*mA*mG*mC | 19 | 66.4 | 68% | 74% | 3 | 0.59 | 0.66 |
| 111 | DKLS62 9290 | mG*mC*TmG*mA*mC*mG*mG*mC*mG*mC*mA*mC*mC*mG*mG*mC*mA*mG*mA*mA | 20 | 66.54 | 65% | 70% | 3 | 0.67 | 0.93 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 112 | DKLS621499 | mU*mG*mA*mG*mC*mA*mG*mU*mA*mC*mA*mA*mC*mU*mG | 20 | 61.5 | 55% | 65% | 0 | 1.10 | 1.11 |
| 113 | DKLS765774 | mG*mG*mG*mC*mG*mG*mA*mC*mC*mA*mU*mA*mC*mC*mA*mC*mA*mA*mC*mG | 20 | 63.45 | 70% | 65% | 2 | 0.52 | 0.53 |
| 114 | DKLS656574 | mG*mA*mA*mA*mG*mA*mA*mA*mG*mU*mA*mA*mC*mC*mU*mG*mG*mG | 20 | 56.32 | 50% | 80% | 3 | 0.79 | 0.82 |
| 115 | DKLS859346 | mC*mA*mG*mU*mA*mG*mC*mC*mA*mC*mC*mU*mU*mA*mC*mC*mC*mG | 20 | 48.91 | 50% | 40% | 1 | 0.39 | 0.47 |
| 116 | DKLS812894 | mC*mA*mC*mC*mG*mU*mC*mA*mA*mU*mC*mA*mA*mC*mC*mG*mG | 20 | 54.35 | 60% | 40% | 0 | 0.51 | 0.41 |
| 117 | DKLS817119 | mC*mA*mC*mC*mU*mC*mG*mU*mC*mU*mU*mC*mG*mC*mG*mG | 20 | 52.54 | 65% | 35% | 2 | 0.49 | 0.56 |
| 118 | DKLS333877 | mC*mU*mG*mU*mG*mU*mG*mG*mC*mC*mC*mA*mU*mA*mC*mC*mG*mG | 20 | 55.09 | 60% | 40% | 2 | 0.51 | 0.55 |
| 119 | DKLS357796 | mC*mA*mG*mA*mG*mA*mA*mG*mU*mG*mU*mA*mA*mC*mG | 19 | 59.1 | 63% | 68% | 3 | 0.92 | 0.78 |
| 120 | DKLS420640 | mC*mA*mG*mA*mG*mA*mG*mC*mA*mG*mU*mA*mA*mC | 18 | 59.29 | 61% | 67% | 2 | 0.71 | 0.64 |
| 121 | DKLS463357 | mC*mA*mG*mA*mG*mA*mG*mG*mU*mA*mA*mC*mG*mA | 17 | 55.55 | 59% | 71% | 2 | 1.46 | 1.19 |
| 122 | DKLS374580 | mC*mA*mG*mA*mG*mA*mG*mC*mA*mC*mC*mA*mC*mG | 16 | 53.89 | 63% | 69% | 2 | 0.53 | 0.46 |
| 123 | DKLS840764 | mC*mA*mG*mA*mG*mA*mG*mC*mA*mC*mA*mU*mA*mC | 15 | 53.33 | 60% | 67% | 0 | 0.21 | 0.39 |
| 124 | DKLS860782 | mC*mA*mG*mA*mG*mC*mA*mG*mU*mA*mA | 14 | 48.49 | 57% | 71% | 0 | 0.46 | 0.61 |
| 125 | DKLS834767 | mC*mA*mG*mA*mG*mC*mA*mG*mC*mA*mG*mU | 13 | 48.94 | 62% | 69% | 0 | -0.01 | 0.27 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 126 | DKLS80 5605 | mC*mA*mG*mA*mG*mG*mC*mA*mG*mC*mA*mG | 12 | 47.75 | 67% | 75% | 0 | 0.10 | 0.26 |
| 127 | DKLS41 5889 | mC*mA*mG*mA*mG*mG*mG*mC*mA*mC*mA | 11 | 43.28 | 64% | 73% | 0 | 0.15 | 0.35 |
| 128 | DKLS78 6970 | mC*mA*mG*mA*mG*mG*mG*mC*mA*mG*mC | 10 | 42.41 | 70% | 70% | 0 | -0.04 | 0.20 |
| 129 | DKLS86 0509 | mC*mA*mG*mA*mG*mA*mG*mG*mC*mA*mG | 9 | 32.2 | 67% | 78% | 0 | 0.10 | 0.12 |
| 130 | DKLS77 1223 | mC*mA*mG*mA*mG*mG*mC*mA | 8 | 24.2 | 63% | 75% | 0 | 0.07 | 0.14 |
| 131 | DKLS33 4259 | mA*mG*mA*mG*mG*mC*mA*mG*mC*mA*mG*mU*mA*mC*mG*mA*mC*mG*mG | 19 | 62.59 | 63% | 74% | 3 | 1.10 | 1.02 |
| 132 | DKLS95 8923 | mG*mA*mG*mA*mG*mG*mC*mA*mG*mC*mA*mG*mU*mA*mC*mG*mA*mC*mG | 18 | 61.23 | 67% | 72% | 2 | 1.06 | 0.77 |
| 133 | DKLS88 9313 | mA*mG*mA*mG*mG*mC*mA*mG*mC*mA*mG*mU*mA*mC*mG*mA*mC*mG | 17 | 59.54 | 65% | 71% | 3 | 0.80 | 0.68 |
| 134 | DKLS71 7876 | mG*mG*mC*mA*mG*mC*mA*mG*mU*mA*mC*mG*mA*mC*mG*mG | 16 | 57.88 | 69% | 69% | 3 | 0.49 | 0.64 |
| 135 | DKLS75 7016 | mG*mC*mA*mG*mC*mA*mG*mU*mA*mC*mG*mA*mC*mG*mG | 15 | 53.53 | 67% | 67% | 3 | 0.31 | 0.46 |
| 136 | DKLS73 4654 | mC*mA*mG*mC*mA*mG*mU*mA*mC*mG*mA*mC*mG*mG | 14 | 47.91 | 64% | 64% | 0 | 0.26 | 0.37 |
| 137 | DKLS76 2544 | mA*mG*mC*mA*mG*mU*mA*mC*mG*mA*mC*mG*mG | 13 | 47.13 | 62% | 69% | 1 | 0.24 | 0.37 |
| 138 | DKLS72 7270 | mG*mC*mA*mG*mU*mA*mC*mG*mA*mC*mG*mG | 12 | 43.94 | 67% | 67% | 1 | 0.24 | 0.26 |
| 139 | DKLS94 7541 | mC*mA*mG*mU*mA*mC*mG*mA*mC*mG*mG | 11 | 36.4 | 64% | 64% | 0 | 0.07 | 0.18 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays.
A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 140 | DKLS44 7399 | mA*mG*mU*mA*mC*mG*mA*mC*mG*mG | 10 | 34.23 | 60% | 70% | 0 | -0.02 | 0.14 |
| 141 | DKLS52 5146 | mG*mU*mA*mC*mG*mA*mC*mG*mG | 9 | 28.9 | 67% | 67% | 0 | -0.05 | 0.07 |
| 142 | DKLS84 8880 | mU*mA*mC*mG*mA*mC*mG*mG | 8 | 24.4 | 63% | 63% | 0 | -0.06 | 0.03 |
| 143 | DKLS86 8095 | mA*mG*mA*mG*mC*mC*mA*mG*mC*mA*mG*mU*mA*mC*mG*mA*mC*mG | 18 | 59.25 | 61% | 72% | 3 | 0.81 | 0.96 |
| 144 | DKLS77 6802 | mG*mA*mG*mG*mC*mA*mG*mU*mA*mC*mG*mA*mC*mG*mA*mC | 16 | 57.53 | 63% | 69% | 2 | 0.44 | 0.67 |
| 145 | DKLS87 3408 | mA*mG*mG*mC*mA*mG*mU*mA*mC*mG*mA*mC*mG*mA | 14 | 50.65 | 57% | 71% | 2 | 1.02 | 1.05 |
| 146 | DKLS92 9958 | mG*mG*mC*mA*mG*mU*mA*mC*mG*mA*mC*mG | 12 | 45.32 | 67% | 67% | 0 | 0.11 | 0.26 |
| 147 | DKLS87 0416 | mG*mC*mA*mG*mU*mA*mC*mG*mA*mC | 10 | 33.28 | 60% | 60% | 0 | -0.03 | 0.15 |
| 148 | DKLS90 4311 | mC*mA*mG*mC*mA*mG*mU*mA | 8 | 11.4 | 50% | 63% | 0 | -0.07 | 0.05 |
| 149 | DKLS85 8330 | CAGAGGCAGCAGTACGACGG | 20 | 60.2 | 65% | 70% | 0 | 0.04 | 0.03 |
| 150 | DKLS18 4327 | mG*mU*mG*mC*mA*TGGAATCACGmG*mA*mG*mU*mG | 20 | 54.67 | 55% | 65% | 0 | 0.04 | -0.06 |
| 151 | DKLS93 4835 | mGmUmGmCmAmUmGmGmAmAmUmCmAmCmGmGmAmGmUmG | 20 | 55.4 | 55% | 65% | 0 | 0.00 | -0.03 |
| 152 | DKLS94 5812 | mG*mU*mG*mC*mAmUmGmGmAmAmUmCmAmCmGmGmA*mG*mU*mG | 20 | 55.4 | 55% | 65% | 1 | -0.03 | 0.04 |
| 153 | DKLS57 7569 | C*A*G*A*G*G*C*A*G*C*A*G*U*A*C*G*A*C*G*G | 20 | 60.2 | 65% | 70% | 3 | 1.03 | 1.44 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 154 | DKLS72 2361 | mG*mU*mG*mC*mA*mU*mG*mG*mA*mU*mC*mG*mA*mC*mG*mA*mG*mU*mG*mG*mU*mG*mU*mG* mU*mG*mU*mC*mA*mU*mG*mG*mA*mA | 30 | 65.03 | 53% | 67% | 0 | 1.53 | 4.08 |
| 155 | DKLS72 1579 | mG*mA*mG*mU*mG*mG*mC*mC*mC*mC*mG*mU*mG*mG*mA*mG*mC*mG*mU*mA*mU*mA*mU*mA | 20 | 53.88 | 55% | 65% | 3 | 1.39 | 2.66 |
| 156 | DKLS74 6864 | mC*mG*mC*mU*mU*mA*mU*mG*mA*mC*mG*mG*mG*mC*mC*mG*mG*mA*mU*mU*mG*mU | 20 | 54.9 | 55% | 65% | 2 | 1.79 | 2.37 |
| 157 | DKLS74 4278 | mG*mG*mU*mU*mA*mA*mG*mA*mG*mC*mG*mG*mG*mU*mG*mU*mA*mU*mC*mA*mA*mU | 20 | 59.53 | 55% | 65% | 0 | 1.55 | 5.71 |
| 158 | DKLS42 1479 | mG*mU*mA*mG*mG*mC*mA*mU*mG*mG*mG*mU*mC*mU*mA*mA*mG*mG*mA*mU | 20 | 57.52 | 55% | 65% | 3 | 0.55 | 0.59 |
| 159 | DKLS95 8321 | mG*mG*mG*mG*mU*mU*mG*mG*mU*mC*mA*mU*mC*mG*mG*mA*mG*mU*mG | 20 | 55.4 | 55% | 65% | 3 | 0.79 | 0.95 |
| 160 | DKLS71 0955 | mG*mG*mU*mU*mA*mU*mA*mU*mG*mG*mC*mG*mG*mA*mA*mC*mU*mU*mA*mU | 20 | 55.81 | 55% | 65% | 2 | 1.37 | 1.63 |
| 161 | DKLS70 1719 | mG*mU*mG*mG*mC*mU*mA*mG*mG*mG*mA*mA*mA*mC*mU*mG*mG*mG*mU*mG | 20 | 53.57 | 50% | 65% | 3 | 0.56 | 0.82 |
| 162 | DKLS65 3496 | mC*mA*mG*mC*mA*mC*mA*mU*mU*mA*mG*mA*mA*mU*mC*mU*mC*mA*mU*mG | 20 | 52.16 | 50% | 65% | 2 | 0.49 | 0.88 |
| 163 | DKLS37 7200 | mG*mG*mG*mU*mG*mG*mC*mA*mG*mC*mA*mG*mU*mU*mA*mU*mG*mG*mG*mG | 20 | 57.88 | 60% | 70% | 0 | 1.19 | 2.32 |
| 164 | DKLS64 4620 | mG*mU*mG*mU*mG*mU*mA*mG*mC*mA*mA*mA*mC*mA*mC*mA*mU*mG*mA*mG | 20 | 55.97 | 50% | 70% | 3 | 0.57 | 0.83 |
| 165 | DKLS68 3540 | mG*mU*mU*mC*mC*mA*mU*mC*mU*mC*mU*mC*mU*mC*mU*mA*mA*mU*mA*mG | 20 | 45.8 | 50% | 40% | 2 | 0.40 | 0.70 |
| 166 | DKLS96 8463 | mC*mC*mU*mC*mC*mU*mU*mA*mU*mA*mU*mC*mC*mA*mC*mA*mU*mU*mU | 20 | 44.01 | 45% | 40% | 1 | 0.35 | 0.62 |
| 167 | DKLS75 3270 | mG*mU*mC*mC*mU*mU*mC*mU*mU*mC*mC*mA*mU*mC*mC*mA*mC*mG*mU*mG | 20 | 42.64 | 50% | 35% | 2 | 0.35 | 0.74 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 168 | DKLS75 4387 | mG*mU*mG*mC*mA*mU*mG*mA*mU*mC*mA*mU*mC*mG*mG*mA*mG*mU | 19 | 54.15 | 53% | 63% | 3 | 0.47 | 1.24 |
| 169 | DKLS62 8743 | mG*mU*mG*mC*mA*mU*mG*mU*mU*mG*mA*mU*mG*mC*mU*mA*mC*mA*mG | 18 | 53.62 | 56% | 67% | 3 | 0.39 | 1.03 |
| 170 | DKLS81 2155 | mG*mU*mG*mC*mU*mG*mC*mA*mU*mG*mU*mU*mA*mU*mA*mC*mG*mA | 17 | 51.27 | 53% | 65% | 2 | 1.00 | 2.06 |
| 171 | DKLS82 0015 | mG*mU*mG*mG*mC*mA*mU*mG*mU*mA*mU*mU*mA*mC*mG*mG | 16 | 49.53 | 56% | 63% | 3 | 0.29 | 0.66 |
| 172 | DKLS67 2961 | mG*mU*mG*mC*mA*mU*mG*mC*mA*mU*mG*mU*mC*mA*mG | 15 | 44.53 | 53% | 60% | 2 | 0.16 | 0.57 |
| 173 | DKLS88 2074 | mG*mU*mG*mC*mA*mU*mG*mU*mU*mA*mU*mA*mC | 14 | 42.64 | 50% | 57% | 1 | 0.17 | 0.45 |
| 174 | DKLS34 2515 | mG*mU*mG*mG*mC*mA*mU*mG*mU*mA*mU*mC*mA | 13 | 37.19 | 46% | 62% | 1 | 0.25 | 0.72 |
| 175 | DKLS97 0986 | mG*mU*mG*mC*mA*mU*mG*mU*mG*mA*mU*mC | 12 | 35.9 | 50% | 58% | 1 | 0.17 | 0.42 |
| 176 | DKLS41 4293 | mG*mU*mG*mC*mA*mU*mG*mU*mG*mA*mU | 11 | 31.59 | 45% | 64% | 0 | 0.04 | 0.28 |
| 177 | DKLS36 9957 | mG*mU*mG*mC*mA*mU*mG*mU*mG*mA | 10 | 29.46 | 50% | 70% | 1 | 0.30 | 0.61 |
| 178 | DKLS33 0818 | mG*mU*mG*mC*mA*mU*mG*mU*mG*mA | 9 | 26.3 | 56% | 67% | 0 | 0.06 | 0.15 |
| 179 | DKLS88 1730 | mG*mU*mG*mC*mA*mU*mG | 8 | 21.3 | 63% | 63% | 0 | -0.05 | -0.01 |
| 180 | DKLS40 3667 | mU*mG*mU*mG*mA*mU*mA*mA*mU*mC*mC*mA*mU*mC*mG*mA*mG*mU*mG | 19 | 54.65 | 53% | 63% | 2 | 0.56 | 2.32 |
| 181 | DKLS47 4224 | mG*mC*mA*mU*mG*mG*mA*mA*mU*mC*mC*mA*mU*mC*mG*mA*mG*mU*mG | 18 | 53.62 | 56% | 67% | 3 | 0.50 | 1.00 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 182 | DKLS95 9154 | mC*mA*mU*mG*mA*mA*mU*mC*mA*mC*mG*mG*mA*mG*mU*mG | 17 | 48.98 | 53% | 65% | 3 | 0.37 | 0.77 |
| 183 | DKLS48 5681 | mA*mU*mG*mG*mA*mA*mU*mC*mA*mC*mG*mG*mA*mG*mU*mG | 16 | 48.43 | 50% | 69% | 1 | 0.06 | 0.78 |
| 184 | DKLS46 3625 | mU*mG*mG*mA*mA*mU*mC*mA*mC*mG*mG*mA*mG*mU*mG | 15 | 48.14 | 53% | 67% | 1 | 0.11 | 0.66 |
| 185 | DKLS79 9151 | mG*mG*mA*mA*mU*mC*mA*mC*mG*mG*mA*mG*mU*mG | 14 | 46.3 | 57% | 71% | 1 | 0.16 | 0.47 |
| 186 | DKLS96 5031 | mG*mA*mA*mU*mC*mA*mC*mG*mG*mA*mG*mU*mG | 13 | 40.02 | 54% | 69% | 0 | 0.08 | 0.25 |
| 187 | DKLS53 0510 | mA*mA*mU*mC*mA*mC*mG*mG*mA*mG*mU*mG | 12 | 36.6 | 50% | 67% | 0 | 0.05 | 0.30 |
| 188 | DKLS88 1554 | mA*mU*mC*mA*mC*mG*mG*mA*mG*mU*mG | 11 | 34.73 | 55% | 64% | 0 | 0.04 | 0.26 |
| 189 | DKLS90 9932 | mU*mC*mA*mC*mG*mG*mA*mG*mU*mG | 10 | 33.05 | 60% | 60% | 0 | 0.08 | 0.25 |
| 190 | DKLS83 5077 | mU*mG*mC*mA*mU*mG*mG*mA*mA*mU*mC*mA*mC*mG*mG*mA*mG*mU | 18 | 53.27 | 50% | 61% | 0 | 0.55 | 2.74 |
| 191 | DKLS67 0217 | mG*mC*mA*mU*mG*mG*mA*mA*mU*mC*mA*mC*mG*mG*mA*mG | 16 | 51.36 | 56% | 69% | 2 | 0.18 | 0.56 |
| 192 | DKLS50 2504 | mC*mA*mU*mG*mG*mA*mA*mU*mC*mA*mC*mG*mG*mA | 14 | 42.62 | 50% | 64% | 2 | 0.56 | 0.80 |
| 193 | DKLS47 2198 | mA*mU*mG*mG*mA*mA*mU*mC*mA*mC*mG*mG | 12 | 38.7 | 50% | 67% | 0 | 0.03 | 0.26 |
| 194 | DKLS47 5358 | mU*mG*mG*mA*mA*mU*mC*mA*mC*mG | 10 | 28.73 | 50% | 60% | 0 | 0.06 | 0.22 |
| 195 | DKLS53 4320 | mG*mG*mA*mA*mU*mC*mA*mC | 8 | 14.6 | 50% | 63% | 0 | 0.10 | 0.01 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 196 | DKLS63 6275 | mC*mA*mC*mG*mU*mA*mC*mC*mU*mU*mA*mG*mU*mG*mU*mC*mC*mU*mC*mA*mA*mC*m A*mC*mG*mU*mA*mC*mC*mU | 30 | 58.86 | 53% | 33% | 1 | 0.63 | 2.24 |
| 197 | DKLS61 5979 | mC*mA*mC*mG*mG*mA*mG*mU*mG | 9 | 28.7 | 67% | 67% | 0 | 0.04 | 0.14 |
| 198 | DKLS65 9460 | mC*mA*mC*mG*mU*mA*mC*mC*mU*mU*mA*mG*mU*mG*mU*mC*mC*mU*mA*mC | 20 | 51.56 | 55% | 35% | 1 | 0.32 | 0.80 |
| 199 | DKLS64 6683 | mC*mA*mC*mG*mU*ACCTTAGTGCmC*mU*mC*mA*mC | 20 | 50.96 | 55% | 35% | 0 | 0.05 | 0.20 |
| 200 | DKLS96 6527 | mCmAmCmGmUmAmCmCmUmUmAmGmUmGmUmCmCmUmAmC | 20 | 51.56 | 55% | 35% | 0 | 0.04 | 0.01 |
| 201 | DKLS33 3772 | mC*mA*mC*mGmUmAmCmCmUmUmAmGmUmGmCmCmU*mC*mA*mC | 20 | 51.56 | 55% | 35% | 0 | 0.02 | 0.08 |
| 202 | DKLS98 1407 | mA*mC*mG*mG*mA*mG*mU*mG | 8 | 24.9 | 63% | 75% | 0 | 0.04 | 0.29 |
| 203 | DKLS66 9778 | G*U*G*C*A*U*G*G*A*A*U*C*A*C*G*A*G*U*G | 20 | 56.3 | 55% | 65% | 3 | 0.76 | 1.30 |
| 204 | DKLS40 4613 | mC*mA*mC*mG*mU*mA*mC*mC*mU*mU*mA*mG*mU*mG*mC | 15 | 41.13 | 53% | 40% | 0 | 0.12 | 0.73 |
| 205 | DKLS64 9547 | mC*mA*mC*mG*mU*mA*mC*mC*mU*mU | 10 | 20.92 | 50% | 30% | 0 | -0.14 | 0.17 |
| 206 | DKLS43 8994 | mG*mC*mG*mC*mC*mU*mU*mA*mC*mC*mG*mU*mC*mC*mU*mC*mA*mC*mA*mA | 20 | 49.41 | 55% | 35% | 1 | 0.71 | 2.07 |
| 207 | DKLS49 1049 | mG*mC*mA*mC*mG*mU*mC*mC*mU*mC*mC*mG*mC*mC*mA*mA*mU*mC*mU*mA | 20 | 50.7 | 55% | 35% | 1 | 0.46 | 1.67 |
| 208 | DKLS46 6380 | mG*mA*mC*mG*mU*mA*mC*mC*mU*mU*mA*mG*mU*mA*mC*mC*mC*mA*mC | 20 | 53.99 | 55% | 40% | 0 | 0.23 | 1.03 |
| 209 | DKLS40 4663 | mC*mA*mC*mG*mU*mA*mC*mC*mU*mU*mA*mG*mU*mG*mC*mC*mU*mC*mC | 20 | 50.63 | 55% | 35% | 1 | 0.30 | 1.18 |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 210 | DKLS64 5944 | mC*mA*mG*mA*mA*mC*mG*mU*mA*mA*mG*mG*mU*mC*mA*mC | 20 | 56.46 | 55% | 65% | 1 | 1.46 | 6.75 |
| 211 | DKLS62 7907 | mC*mA*mC*mG*mA*mU*mG*mA*mG*mG*mA*mG*mU*mG*mA*mC*mA*mC | 20 | 61.23 | 60% | 65% | 1 | 1.73 | 16.20 |
| 212 | DKLS34 1370 | mCmUmCmAmUmUmCmCmUmAmCmCmGmAmCmAmCmCmC | 20 | 54.34 | 60% | 25% | 0 | 0.08 | 0.37 |
| 213 | DKLS77 6792 | mA*mG*mG*mA*mA*mG*mG*mA*mA*mA*mG*mA*mG*mG*mA*mG | 20 | 64.39 | 50% | 100% | 0 | 2.02 | 13.19 |
| 214 | DKLS40 2835 | mA*mG*mG*mG*mA*mG*mG*mA*mA*mA*mG*mA*mG*mA*mG*mG | 20 | 65.82 | 50% | 100% | 0 | 2.61 | |
| 215 | DKLS44 4294 | mA*mG*mG*mA*mG*mA*mG*mG*mA*mA*mA | 15 | 54.64 | 47% | 100% | 0 | 2.39 | |
| 216 | DKLS65 6105 | mA*mG*mG*mG*mA*mG*mA*mA*mG*mA*mA*mG*mA | 15 | 54.04 | 47% | 100% | 0 | 1.00 | |
| 217 | DKLS49 2769 | mA*mG*mG*mA*mA*mG*mA*mG | 10 | 34.61 | 50% | 100% | 0 | -0.06 | |
| 218 | DKLS46 6440 | GUGCAUGGAAUCACGGAGUG | 20 | 56.3 | 55% | 65% | 0 | -0.05 | -0.01 |
| 219 | DKLS69 3540 | mU*mC*mC*mU*mU*mC*mU*mC*mC*mU*mU*mU*mC*mC*mU*mC | 20 | 42.5 | 50% | 0% | 0 | 0.08 | |
| 220 | DKLS40 3215 | mC*mU*mU*mU*mU*mC*mC*mU*mC*mC*mC*mC*mC*mU*mU*mU*mC | 20 | 39.66 | 50% | 0% | 0 | 0.06 | |
| 221 | DKLS95 1212 | mU*mC*mC*mC*mU*mC*mC*mC*mC*mU*mU | 15 | 32.98 | 47% | 0% | 0 | -0.08 | |
| 222 | DKLS67 9059 | mC*mU*mU*mC*mU*mU*mC*mC*mU*mC*mC*mU*mC | 15 | 33.99 | 53% | 0% | 0 | 0.05 | |
| 223 | DKLS80 2578 | mG*mU*mG*mC*mC*mU*mG*mU*mU*mA*mC*mG*mC*mC*mU*mG | 20 | 49.62 | 55% | 35% | 1 | 0.15 | |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows:
m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 224 | DKLS41 0263 | mC*mA*mG*mA*mG*mC*mA*mA*mU*mA*mG*mA*mA*mG*mG | 20 | 57.81 | 50% | 80% | 2 | 0.59 | |
| 225 | DKLS55 1191 | mC*mG*mU*mG*mU*mA*mA*mG*mG*mA*mG*mU*mC*mA*mC*mG | 21 | 54.87 | 62% | 62% | 2 | 0.43 | |
| 226 | DKLS54 0345 | mC*mU*mG*mU*mA*mC*mC*mG*mG*mC*mG*mU*mA*mA*mG | 20 | 53.77 | 60% | 55% | 2 | 0.84 | |
| 227 | DKLS88 5676 | mC*mU*mG*mU*mA*mC*mA*mC*mG*mA*mA*mC*mG*mU*mC*mA*mG | 20 | 55.09 | 55% | 65% | 2 | 0.38 | |
| 228 | DKLS62 9224 | mA*mG*mU*mC*mG*mC*mC*mG*mC*mG*mA*mC*mG*mA*mC*mC*mU | 22 | 64.2 | 68% | 59% | 1 | 0.73 | |
| 229 | DKLS48 2695 | mC*mG*mU*mG*mC*mA*mC*mU*mU*mC*mG*mU*mC*mG*mU*mA*mC*mG | 21 | 51.17 | 62% | 38% | 2 | 0.25 | |
| 230 | DKLS54 6051 | mC*mU*mG*mU*mA*mU*mU*mC*mG*mU*mC*mG*mC*mA*mC*mG | 20 | 49.28 | 60% | 45% | 2 | 0.47 | |
| 231 | DKLS57 4356 | mC*mU*mG*mA*mC*mC*mG*mU*mC*mC*mG*mU*mA*mC*mG | 20 | 48.02 | 55% | 35% | 1 | 0.18 | |
| 232 | DKLS58 0658 | mA*mG*mU*mC*mC*mG*mU*mC*mC*mC*mG*mC*mG*mA*mC*mC*mU | 22 | 59.15 | 68% | 41% | 1 | 0.55 | |
| 233 | DKLS38 9392 | mG*mA*mA*mG*mC*mG*mC*mG*mU*mG*mA*mC*mU*mG*mU*mU*mC*mG*mU*mC*mA*mC*mG | 25 | 60.64 | 60% | 68% | 2 | 1.14 | |
| 234 | DKLS37 9914 | mG*mA*mA*mG*mC*mC*mG*mA*mA*mA*mC*mU*mU*mC*mG*mU*mC*mG*mU*mC*mA*mC*mG | 25 | 57.42 | 60% | 48% | 2 | 0.77 | |
| 235 | DKLS87 2305 | mC*mG*mU*mG*mA*mC*mC*mA*mA*mA*mG*mU*mU*mC*mG*mU*mC*mA*mC*mG*mA*mA*mG | 25 | 60.08 | 60% | 68% | 2 | 0.77 | |
| 236 | DKLS36 1530 | mC*mG*mU*mG*mA*mC*mA*mC*mA*mC*mA*mA*mU*mU*mC*mG*mU*mC*mG*mU*mC*mA*mC*mG | 25 | 56.93 | 60% | 48% | 2 | 0.60 | |
| 237 | DKLS32 3181 | mA*mC*mC*mG*mA*mA*mC*mA*mA*mU*mA*mA*mU*mC*mC*mA*mC*mU*mA | 20 | 47.12 | 35% | 55% | 1 | 0.48 | |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2′OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 238 | DKLS56 8543 | mU*mG*mU*mU*mA*mU*mG*mU*mG*mU*mC*mC*mG*mC*mA*mA*mA*mA | 20 | 45.44 | 45% | 50% | 2 | 0.98 | |
| 239 | DKLS56 5265 | mC*mG*mG*mA*mC*mG*mG*mU*mC*mC*mU*mC*mC*mA*mC*mG*mU*mU*mU*mC | 20 | 57.66 | 70% | 40% | 2 | 0.52 | |
| 240 | DKLS60 8727 | mG*mU*mU*mA*mG*mU*mA*mC*mC*mU*mU*mG*mU*mG*mU*mA*mU*mU | 20 | 41.74 | 40% | 45% | 2 | 0.59 | |
| 241 | DKLS60 7664 | mG*mG*mA*mC*mA*mA*mA*mC*mG*mU*mU*mU*mG*mU*mC*mA*mC*mG | 20 | 56.72 | 65% | 60% | 0 | 0.87 | |
| 242 | DKLS60 3765 | mC*mU*mC*mG*mU*mG*mA*mU*mG*mA*mU*mC*mU*mU*mA*mC*mC*mG | 20 | 53.28 | 60% | 40% | 0 | 0.19 | |
| 243 | DKLS55 7745 | mA*mA*mA*mU*mA*mU*mC*mU*mA*mU*mU*mG*mU*mC*mC*mA*mU*mC | 20 | 55.14 | 55% | 45% | 0 | 0.25 | |
| 244 | DKLS60 1882 | mA*mA*mU*mU*mC*mU*mC*mU*mU*mA*mU*mA*mA*mC*mU*mC*mU*mG | 20 | 41.33 | 35% | 50% | 1 | 0.17 | |
| 245 | DKLS59 6033 | mA*mA*mU*mG*mU*mC*mC*mG*mU*mC*mC*mC*mG*mU*mC*mA*mU*mU | 20 | 52.97 | 55% | 50% | 2 | 1.20 | |
| 246 | DKLS59 5384 | mC*mA*mG*mA*mG*mG*mC*mA*mU*mC*mU*mU*mA*mG*mU*mU*mG | 20 | 51.28 | 55% | 55% | 0 | 2.10 | |
| 247 | DKLS59 0665 | mU*mC*mC*mG*mU*mG*mA*mU*mC*mA*mU*mU*mC*mC*mC*mC*mC | 20 | 51.8 | 50% | 45% | 2 | 1.05 | |
| 248 | DKLS59 0552 | mU*mC*mC*mC*mU*mU*mU*mU*mA*mU*mU*mC*mG*mU*mG | 20 | 32.86 | 35% | 25% | 1 | 0.39 | |
| 249 | DKLS59 0093 | mA*mA*mU*mG*mC*mC*mA*mA*mU*mA*mG*mU*mC*mU*mC*mG*mA*mG | 20 | 54.47 | 55% | 55% | 1 | 1.52 | |
| 250 | DKLS58 7566 | mG*mG*mG*mC*mC*mC*mC*mU*mA*mC*mC*mG*mA*mU*mC*mA*mU*mC | 20 | 55.9 | 60% | 45% | 1 | 0.83 | |
| 251 | DKLS58 6797 | mC*mG*mC*mC*mU*mC*mU*mG*mU*mG*mU*mA*mG*mG*mU*mC*mA | 20 | 51.27 | 60% | 40% | 2 | 0.55 | |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 252 | DKLS58 2677 | mU*mA*mC*mU*mG*mC*mC*mA*mU*mG*mU*mG*mG*mU*mG*mU*mU*mA*mA*mG | 20 | 50.37 | 50% | 55% | 2 | 0.69 | |
| 253 | DKLS54 6680 | mG*mA*mC*mA*mG*mU*mU*mA*mG*mG*mA*mU*mA*mU*mU*mU*mG*mG | 20 | 57.67 | 50% | 70% | 3 | 0.89 | |
| 254 | DKLS53 0372 | mC*mC*mG*mC*mC*mU*mU*mU*mU*mU*mA*mU*mC*mC*mC*mA*mC*mC*mC*mA | 20 | 43.92 | 50% | 25% | 0 | 0.23 | |
| 255 | DKLS51 9203 | mC*mC*mC*mG*mC*mU*mG*mG*mG*mC*mC*mU*mC*mC*mA*mA*mC*mC*mU*mA | 20 | 61.69 | 70% | 30% | 0 | 0.31 | |
| 256 | DKLS71 1434 | mU*mU*mC*mU*mU*mG*mG*mU*mU*mC*mU*mG*mU*mA*mC*mU*mU*mU*mC*mU | 20 | 42.75 | 45% | 35% | 1 | 0.83 | |
| 257 | DKLS52 0505 | mG*mA*mC*mG*mG*mC*mC*mC*mC*mA*mG*mG*mG*mC*mU*mU*mC*mC*mC*mA | 20 | 60.36 | 65% | 50% | 0 | 1.33 | |
| 258 | DKLS82 7594 | mC*mC*mC*mU*mG*mC*mU*mG*mC*mC*mU*mC*mC*mG*mU*mU*mC*mC*mG | 20 | 52.67 | 65% | 40% | 2 | 0.52 | |
| 259 | DKLS77 5409 | mU*mC*mG*mU*mU*mU*mU*mG*mU*mU*mG*mG*mC*mA*mA*mG*mA*mU*mC*mG*mU | 20 | 49.89 | 50% | 55% | 2 | 0.22 | |
| 260 | DKLS86 5397 | mG*mU*mU*mG*mU*mU*mG*mU*mA*mU*mU*mU*mC*mG*mG*mC*mU*mA*mG*mG | 20 | 51.32 | 55% | 55% | 0 | 0.90 | |
| 261 | DKLS52 0022 | mU*mU*mU*mG*mA*mU*mU*mC*mU*mU*mU*mU*mC*mC*mU*mA*mG*mG | 20 | 39.52 | 40% | 35% | 2 | 0.36 | |
| 262 | DKLS46 3500 | mC*mU*mA*mU*mG*mC*mC*mC*mA*mU*mU*mC*mC*mU*mA*mU*mC*mC*mC | 20 | 54.53 | 50% | 45% | 0 | 0.16 | |
| 263 | DKLS78 4557 | mA*mA*mA*mG*mG*mA*mG*mA*mU*mU*mU*mU*mA*mA*mG*mC*mC*mA*mC*mU*mC | 20 | 50.1 | 45% | 55% | 2 | 0.79 | |
| 264 | DKLS48 4519 | mC*mC*mG*mC*mA*mG*mU*mA*mG*mA*mU*mU*mU*mG*mG | 20 | 45.35 | 40% | 50% | 2 | 0.24 | |
| 265 | DKLS83 1379 | mU*mA*mU*mC*mA*mG*mC*mC*mC*mG*mU*mG*mU*mA*mC*mG*mC*mA | 20 | 50.45 | 50% | 45% | 1 | 1.16 | |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 266 | DKLS93 6805 | mG*mC*mA*mA*mA*mA*mC*mG*mU*mG*mG*mU*mU*mA*mU*mU*mU | 20 | 45.91 | 45% | 55% | 0 | 3.73 | |
| 267 | DKLS83 4800 | mC*mC*mU*mU*mU*mG*mU*mC*mC*mC*mU*mG*mU*mG*mA*mA | 20 | 45.43 | 50% | 35% | 0 | 0.75 | |
| 268 | DKLS80 7309 | mU*mU*mG*mC*mC*mG*mC*mU*mU*mC*mU*mC*mC*mU*mU | 20 | 50.67 | 60% | 20% | 0 | 0.06 | |
| 269 | DKLS17 8323 | mA*mU*mG*mC*mU*mA*mG*mU*mG*mC*mC*mG*mA*mA | 20 | 59.49 | 55% | 55% | 2 | 1.30 | |
| 270 | DKLS62 9418 | mC*mU*mG*mC*mC*mC*mG*mA*mA*mC*mU*mC*mU*mG*mU | 20 | 57.53 | 60% | 40% | 1 | 0.19 | |
| 271 | DKLS68 7192 | mC*mC*mG*mA*mC*mC*mG*mC*mG*mG*mA*mC*mG*mU*mU*mU | 20 | 59.03 | 65% | 55% | 2 | 0.75 | |
| 272 | DKLS70 6542 | mU*mU*mU*mU*mU*mA*mA*mA*mA*mA*mA*mA*mG | 20 | 37.88 | 25% | 65% | 3 | 0.52 | |
| 273 | DKLS70 0850 | mC*mU*mG*mG*mG*mU*mG*mC*mC*mG*mG*mC*mG*mA*mG | 20 | 69.23 | 85% | 65% | 0 | 1.17 | |
| 274 | DKLS79 2825 | mC*mG*mC*mA*mC*mG*mG*mU*mA*mU*mU*mC*mC*mA*mG*mU | 20 | 45.68 | 50% | 40% | 2 | 0.29 | |
| 275 | DKLS79 2598 | mU*mG*mC*mC*mG*mG*mG*mC*mA*mC*mC*mG*mA*mU*mG*mG*mC | 20 | 62.55 | 65% | 55% | 0 | 1.19 | |
| 276 | DKLS82 1415 | mG*mU*mU*mU*mC*mG*mG*mG*mU*mG*mA*mU*mC | 20 | 50.98 | 55% | 50% | 0 | 0.61 | |
| 277 | DKLS83 2163 | mC*mC*mC*mC*mC*mG*mU*mU*mU*mA*mC*mC*mU*mC | 20 | 64.1 | 64% | 25% | 1 | 0.70 | 0.68 |
| 278 | DKLS69 6616 | mC*mC*mU*mG*mU*mG*mC*mC*mA*mC*mC*mC*mU*mC | 20 | 64.6 | 65% | 30% | 1 | 0.85 | 1.30 |
| 279 | DKLS37 0480 | mG*mU*mC*mU*mC*mC*mG*mU*mC*mC*mA*mU*mG*mC*mC*mC | 20 | 68.9 | 69% | 30% | 1 | 0.68 | |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 280 | DKLS36 4918 | mC*mU*mC*mG*mC*mA*mC*mC*mA*mC*mU*mG*mG*mA*mU*mG*mG | 20 | 68.5 | 69% | 45% | 1 | 0.93 | |
| 281 | DKLS32 9687 | mG*mA*mU*mC*mG*mA*mU*mC*mC*mU*mG*mC*mA*mU*mC*mU*mA*mU*mC | 20 | 55.5 | 56% | 50% | 1 | | |
| 282 | DKLS63 6117 | mG*mA*mG*mC*mC*mC*mG*mU*mG*mG*mU*mG*mU*mG*mU*mA*mC*mC | 20 | 68 | 68% | 50% | 1 | 1.28 | |
| 283 | DKLS61 2200 | mG*mA*mU*mC*mC*mC*mU*mC*mA*mU*mG*mG*mA*mA*mU*mC*mC*mA*mC | 20 | 62.1 | 62% | 55% | 1 | 0.81 | |
| 284 | DKLS86 0834 | mG*mG*mU*mC*mA*mC*mC*mU*mG*mG*mC*mC*mU*mG*mG*mA*mU*mA*mC*mG*mA | 20 | 66.6 | 67% | 55% | 1 | | |
| 285 | DKLS4533 158 | mC*mG*mG*mC*mG*mU*mG*mC*mU*mC*mA*mU*mG*mC*mC*mU*mC*mG*mG | 20 | 70.8 | 71% | 40% | 2 | 1.95 | 2.14 |
| 286 | DKLS64 5702 | mC*mC*mA*mG*mC*mU*mG*mG*mA*mG*mC*mC*mU*mC*mC*mC*mU | 20 | 68.6 | 69% | 45% | 2 | | |
| 287 | DKLS62 3338 | mC*mC*mA*mG*mU*mG*mG*mA*mG*mC*mC*mU*mG*mU*mC*mC*mU | 20 | 68.6 | 69% | 45% | 2 | 1.53 | 1.56 |
| 288 | DKLS40 9068 | mC*mU*mG*mA*mG*mC*mC*mG*mU*mG*mU*mU*mG*mU*mG*mU*mG | 20 | 67.8 | 68% | 45% | 2 | 0.98 | 0.75 |
| 289 | DKLS68 4387 | mG*mA*mU*mC*mU*mG*mG*mC*mC*mU*mG*mG*mU*mG*mU*mA | 20 | 66.4 | 66% | 45% | 2 | 1.25 | 1.36 |
| 290 | DKLS48 4655 | mC*mC*mU*mC*mC*mG*mG*mU*mC*mU*mC*mC*mA*mU*mG*mC*mG | 20 | 62.3 | 62% | 50% | 2 | 1.29 | 1.11 |
| 291 | DKLS77 1111 | mC*mA*mG*mC*mC*mC*mU*mC*mC*mU*mA*mU*mG*mC*mC*mG*mA*mG | 20 | 66.9 | 67% | 50% | 2 | | |
| 292 | DKLS82 0087 | mA*mC*mA*mU*mA*mU*mA*mU*mG*mC*mC*mC*mG*mG*mA*mG | 20 | 67.7 | 68% | 50% | 2 | 1.02 | 0.42 |
| 293 | DKLS81 7322 | mU*mA*mG*mU*mC*mC*mG*mU*mU*mA*mC*mG*mC*mC*mG*mA*mG | 20 | 65 | 65% | 50% | 2 | 0.72 | |

TABLE 8-continued

Summary data from the 305 oligomer screen, including oligomer sequence and chemistry, length, melting temperature (Tm) purine and GC content, death score based on a high content screen (HCS) and the oligomer-Thoc4 and -hSSB1 results from SPR binding assays. A high-content screen (HCS) was performed in which the percentage of apoptotic and dead cells was measured and used to assign a death score to each oligomer. Death Scores assigned were: 0 = non toxic, 1 = slightly toxic, 2 = moderately toxic, 3 = highly toxic. (SPR was used to measure binding between oligos and either THOC4 or hSSB1 protein. Scores were calculated by normalizing the Rmax (maximum binding response) for each oligo to the Rmax for the positive and negative control oligos, LSA_In3E3 and Neg_C. Sequence designations are as follows: m = 2'OMe-modified nucleoside, * = phosphorothioate (PS) internucleoside linkage. Tm = melting temperature.

| SEQ ID | NAME | SEQUENCE AND CHEMISTRY | Base # | Tm | % GC | % AG | Death Score | SPR-Thoc4 | SPR-hSSB1 |
|---|---|---|---|---|---|---|---|---|---|
| 294 | DKLS67 5388 | mC*mU*mG*mC*mC*mU*mC*mC*mU*mC*mC*mU*mC*mG*mU*mA*mA*mG | 20 | 64.6 | 65% | 25% | 0 | 0.50 | |
| 295 | DKLS82 7917 | mC*mU*mA*mC*mU*mG*mU*mG*mG*mA*mG*mG*mU*mG*mU*mC*mC*mA*mU | 20 | 65.8 | 66% | 55% | 2 | 1.14 | 1.43 |
| 296 | DKLS84 3537 | mA*mG*mG*mC*mA*mA*mG*mT*mC*mC*mC*mT*mC*mA*mG*mA*mG*mT*mG*mG | 20 | 63.2 | 63% | 55% | 2 | | |
| 297 | DKLS85 9480 | mC*mU*mU*mG*mG*mG*mG*mG*mU*mG*mU*mC*mU*mA*mG*mA*mA*mG | 20 | 65.2 | 65% | 70% | 2 | 3.04 | |
| 298 | DKLS37 1273 | mC*mG*mG*mA*mU*mG*mG*mU*mG*mG*mA*mA*mA*mC*mG*mG*mC*mC*mA*mG*mU | 20 | 63.1 | 63% | 70% | 2 | 2.60 | 1.65 |
| 299 | DKLS65 8030 | mG*mA*mG*mG*mC*mU*mG*mA*mG*mG*mG*mA*mG*mU*mG*mG*mU*mG*mA*mG | 20 | 64.6 | 65% | 75% | 2 | 2.46 | |
| 300 | DKLS50 6891 | mA*mC*mC*mG*mC*mA*mA*mA*mC*mC*mG*mU*mU*mU*mU*mC*mA*mA*mG | 20 | 58.3 | 58% | 60% | 3 | 0.91 | 0.68 |
| 301 | DKLS66 5920 | mG*mC*mC*mG*mC*mA*mC*mC*mA*mG*mU*mA*mG*mG*mC*mG*mC*mC | 20 | 72.4 | 72% | 60% | 3 | 1.51 | 0.88 |
| 302 | DKLS64 9218 | mG*mA*mA*mC*mG*mC*mC*mC*mC*mC*mC*mA*mG*mA*mU*mC*mC*mU*mU*mC | 20 | 64.9 | 65% | 30% | 0 | 1.90 | 0.49 |
| 303 | DKLS99 1101 | mG*mA*mG*mA*mA*mA*mA*mC*mC*mG*mC*mA*mC*mG*mU*mG*mU*mA*mG | 20 | 63.3 | 63% | 70% | 3 | 1.15 | 1.09 |
| 304 | DKLS78 9189 | mG*mC*mC*mU*mA*mC*mU*mC*mU*mU*mU*mC*mC*mC*mA*mA*mG*mU*mC*mA | 20 | 64.3 | 64% | 30% | 0 | 0.67 | 0.88 |
| 305 | DKLS65 1753 | mC*mA*mC*mC*mU*mA*mG*mU*mC*mC*mC*mU*mC*mC*mU*mC*mG*mA*mG | 20 | 64 | 64% | 30% | 0 | 0.78 | |

Oligomer Length

Figure 8:
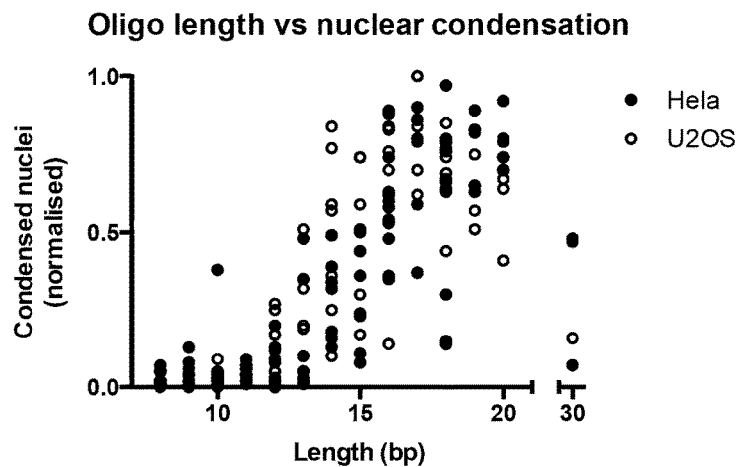
FIG. 8 is a graphic representation showing results of a screen to determine optimal oligomer compound length. Oligomer compounds were stepwise truncated 1 bp at the time from 5' or 3' ends of parent sequences. Data shown is the percentage of cells with condensed nuclei as a marker of apoptosis (data was normalized to the minimum and maximum scores for each plate on a scale of 0-1, 0=lowest death score, 1=highest death score).

Increasing the size of a potent tumor-modulating oligomer (e.g., open_A and ATG_LSA) from 20 nucleobases to 30 nucleobases, reduced or completely abrogated the tumor-modulating phenotype. Decreasing the size to 15 or 10 nucleobases also reduced or abrogated the phenotype. When the size was reduced incrementally, by removing one nucleobase from either the 5' or 3' end, potency was maintained for the first 4-5 nucleobases removed from either end, followed by a gradual decrease in potency for the removal of the subsequent nucleobases (see, TABLE 8). Similarly, when one nucleobase was simultaneously removed from each end, potency was lost after removal of 6 nucleobases. The results exploring the influence of oligomer length on tumor-modulating activity are summarized in FIG. 8. These findings suggest that the minimum size required for maintained potency of LSA oligomer compounds is 14-16 nucleobases and the maximum size is 28-29 nucleobases.

Chemistry

Oligomeric compounds were synthesized using ZEN chemistry (proprietary to IDT), which comprises a fully 2'-O-methyl modified sugar nucleobase backbone with two internal ZEN™ modifications at or near the ends of the oligomer. The 2'-O-methyl residues confer resistance to endonuclease degradation and increases binding affinity to RNA targets, while the ZEN modification blocks exonuclease degradation and further increases binding affinity. These compounds are referred to herein as ZEN oligomers. All ZEN oligomers corresponding to cell death-inducing LSA oligomer sequences completely lost cell death inducing potency. Also a phosphodiester (PD) backbone with no other modification of the nucleobases, or a PD backbone with full 2'-O-methyl modified sugar nucleobases completely abrogated the killing effect. Maintaining full 2'-O-methyl modifications but only three phosphorothioate (PS) residues on each end of the oligomer weakened the killing effect, as did gapmers with non-modified DNA in the middle section of the oligomers. It was concluded that oligomeric compounds which preferably have a full PS backbone and optionally no other modifications, was the preferred chemistry required for maintained and even increased killing effect of the oligomers, as well as binding to one or both of THOC4 and hSSB1 (see, TABLE 8).

Pyrimidine/Purine Content

Figure 9:
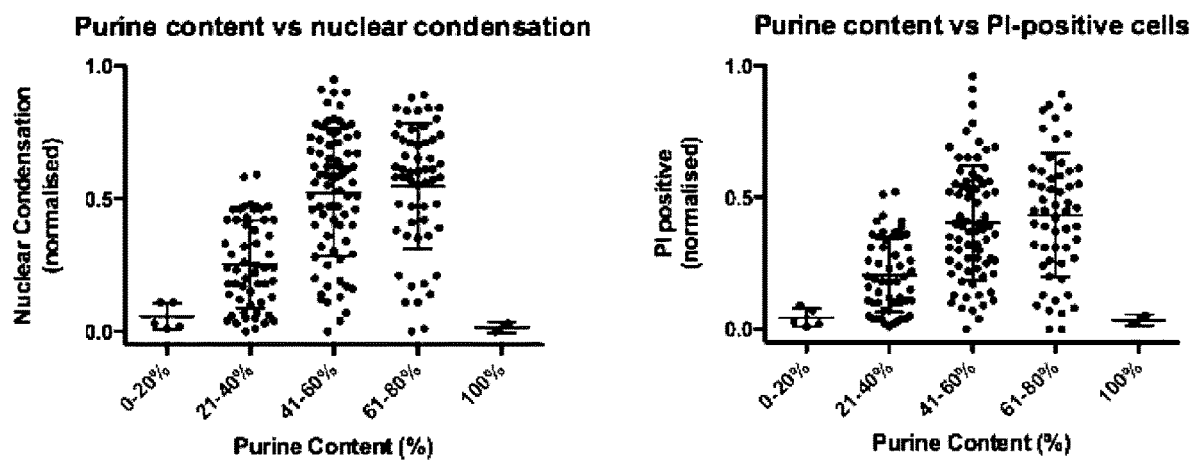
FIG. 9 is a graphic representation showing that purine content correlates with cell death. Dot plots comparing markers of cellular toxicity (nuclear condensation and PI-positive staining). Data was averaged between HeLa and U2OS cells and normalized to the minimum and maximum scores for each plate, 0=lowest PI-positive, 1=highest PI-positive).

The results from the screen revealed that oligomer compounds required a minimum purine content of 50% for tumor-modulating activity, or a minimum purine content of 45% with a minimum GC content of 50% for tumor-modulating activity and that there is a positive correlation between tumor-modulating activity and increased purine content. However, purine content alone is not sufficient to predict activity, as some oligomer compounds with high purine content are not effective. Oligomers designed to contain only purines (A and G) or pyrimidines (C and U) were also ineffective, suggesting a mix of nucleobases is required for activity (see, TABLE 8). The results exploring the influence of purine content on tumor-modulating activity are summarized in FIG. 9.

A number of antisense oligomeric compounds from the literature, some of which are currently in clinical trials for various conditions including cancer (BCL2 Oblimersen, SMN2-N1, dystrophin, clusterin, survivin, EIF4EASO4, Hsp27, Stat3), were modified to match the oligomer chemistry described herein and screened for activity. Specifically, these modified literature oligomers were designed to have a full PS backbone and full 2'-O-methyl modified nucleobases and these oligomers were compared to some of the most potent LSA oligomers tested, IN3LSA, ATG_LSA or Open_A. Among the modified literature oligomeric compounds tested, only one oligomer, dystrophin and one control oligomer HSP27 mm scored the highest death score of 3 compared to oligomers IN3_LSA, ATG_LSA or Open_A disclosed herein, with the majority of modified literature oligomers showing weaker cell death-inducing capacity (scores of 2 or 1), as compared to IN3_LSA, ATG_LSA or Open_A (see, TABLE 8).

Example 6

Oligomer Compounds Inhibit Tumor Cells Growth In Vivo

In Vivo Study

Figure 10:
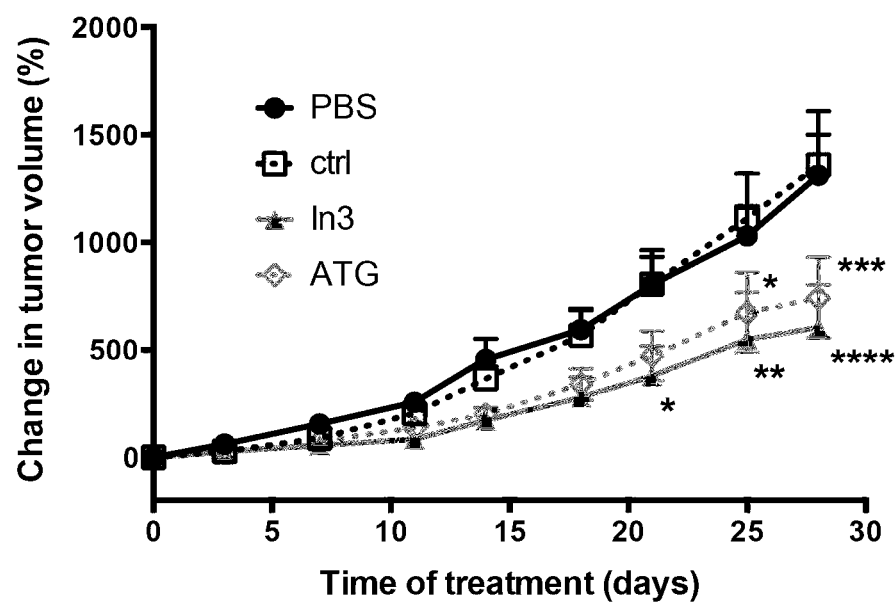
FIG. 10 is a graphic representation showing tumor growth retardation for SCID mice treated with cell death induction effective oligomer compounds IN3LSA (In3, grey triangles) and ATGLSA (ATG, white diamonds) vs. non effective control oligonucleotide (ctrl) and PBS (black dots) over 4 weeks (2 intravenous injections per week). The graph show the average change in tumor volume for at least 7 mice per group+/−SEM. Stars represent statistically significant reduced tumor volumes (ANOVA, α=0.05,* P<0.05,  P<0.01, * P<0.001, **** P<0.0001)
Figure 11:
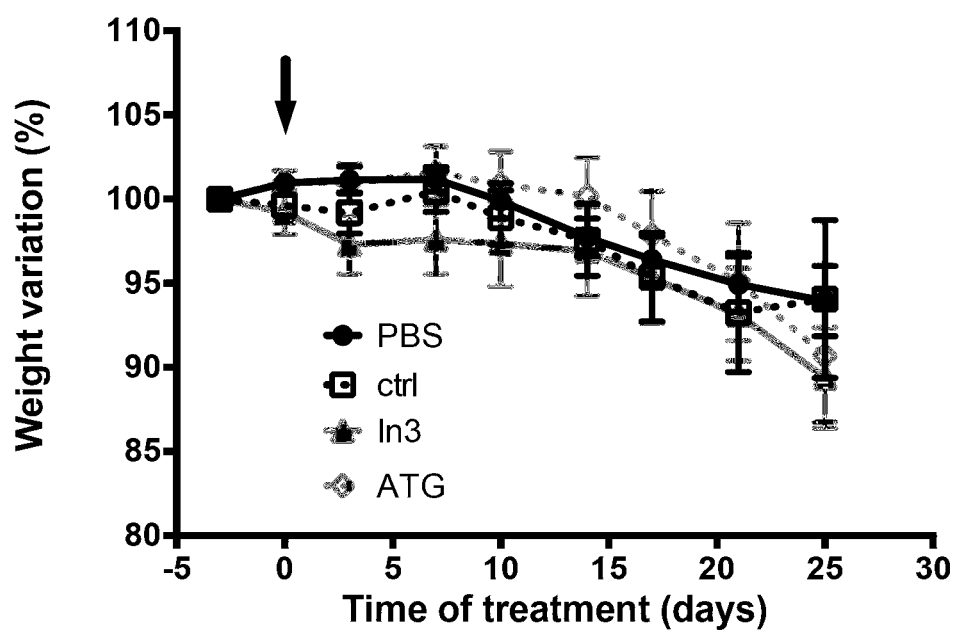
FIG. 11 is a graphic representation showing weight variation of SCID mice treated with oligomer compounds IN3LSA (In3, grey triangles) and ATGLSA (ATG, white diamonds) vs. non effective control oligonucleotide (ctrl) and PBS (black dots) over 4 weeks (2 intravenous injections per week). The graph represents the average weight variation+/−SEM for at least 7 mice per group. The black arrow shows the start of treatment.

Non-targeting oligomers were tested in vivo in a prostate xenograft model. Specifically, 6-wk old SCID males were injected subcutaneously with C42B prostate cancer cells. Once the tumors reached a volume of 50 mm$^3$, the mice were treated with two of tumor-modulating non-targeting oligomers, In3LSA and ATGLSA, alongside a non effective control sequence and PBS. Oligomer drugs were administered by intravenous injection twice weekly at a dose of 80 mg/kg for four weeks. Tumor growth was monitored by caliper measurements during the time of treatment. A statistically significant retardation of tumor growth was observed (see, FIG. 10) for the IN3LSA (In3) and ATGLSA (ATG) treated mice, as compared to control (ctrl) and PBS treated mice (FIG. 11), which demonstrate that these non-targeting oligomers had no significant toxicity on treated mice.

Figure 12:
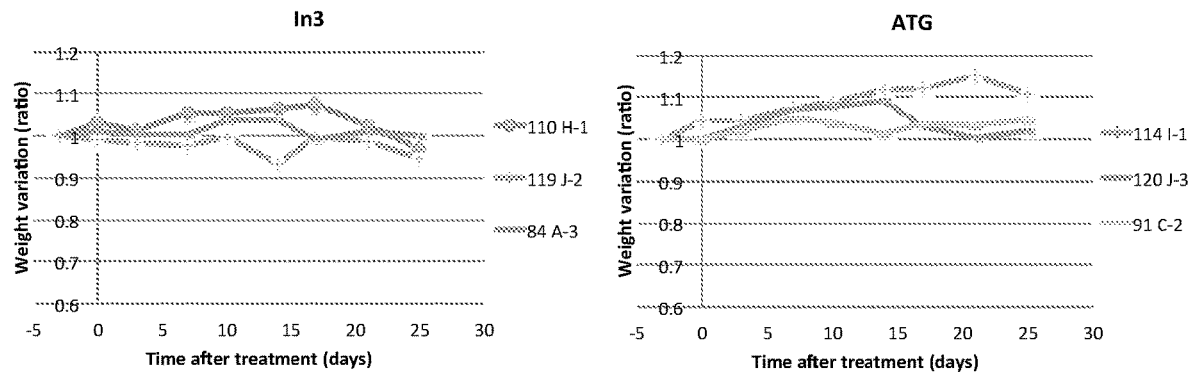
FIG. 12 is a graphic representation showing weight variation for the 3 mice with the most reduced tumors for IN3LSA (In3, mice #110 H-1, 119 J-2 and 84 A-3, left panel) and ATGLSA (ATG, mice #114 I-1, 120 J-3, 91 C-2, right panel) comparing to control and PBS after a 4-week treatment.

During the time of treatment, mice weight was monitored but no significant difference of weight loss was observed between IN3LSA (In3) and ATGLSA (ATG) treated mice, as compared to control (ctrl) and PBS treated mice. Notably, no weight loss was observed for mice with the most reduced tumors for IN3LSA and ATGLSA treated groups (FIG. 12), showing that the weight loss observed in FIG. 11 was most likely due to tumor burden.

Example 7

Oligomer Compounds are Taken Up by Tumor Cells In Vivo

Figure 13:
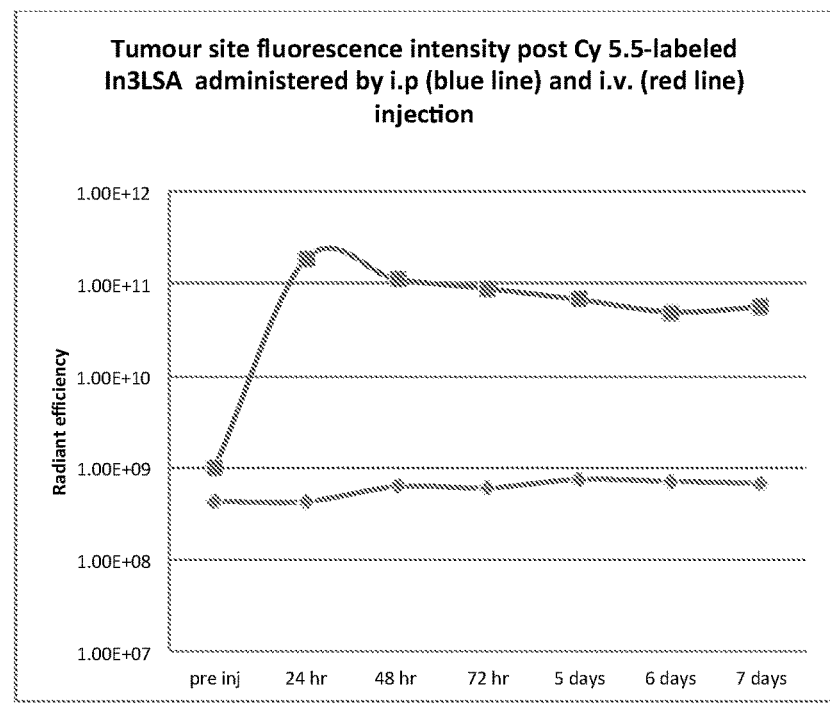
FIG. 13 is a graphic representation showing fluorescent signal at tumor site over time from a Cy 5.5 labeled In3LSA oligomer compound. Intravenous (i.v.) delivery shows a strong and persistent signal at the tumor site while signal post intraperitoneal (i.p.) injection is undetectable at the tumor site.
Figure 14:
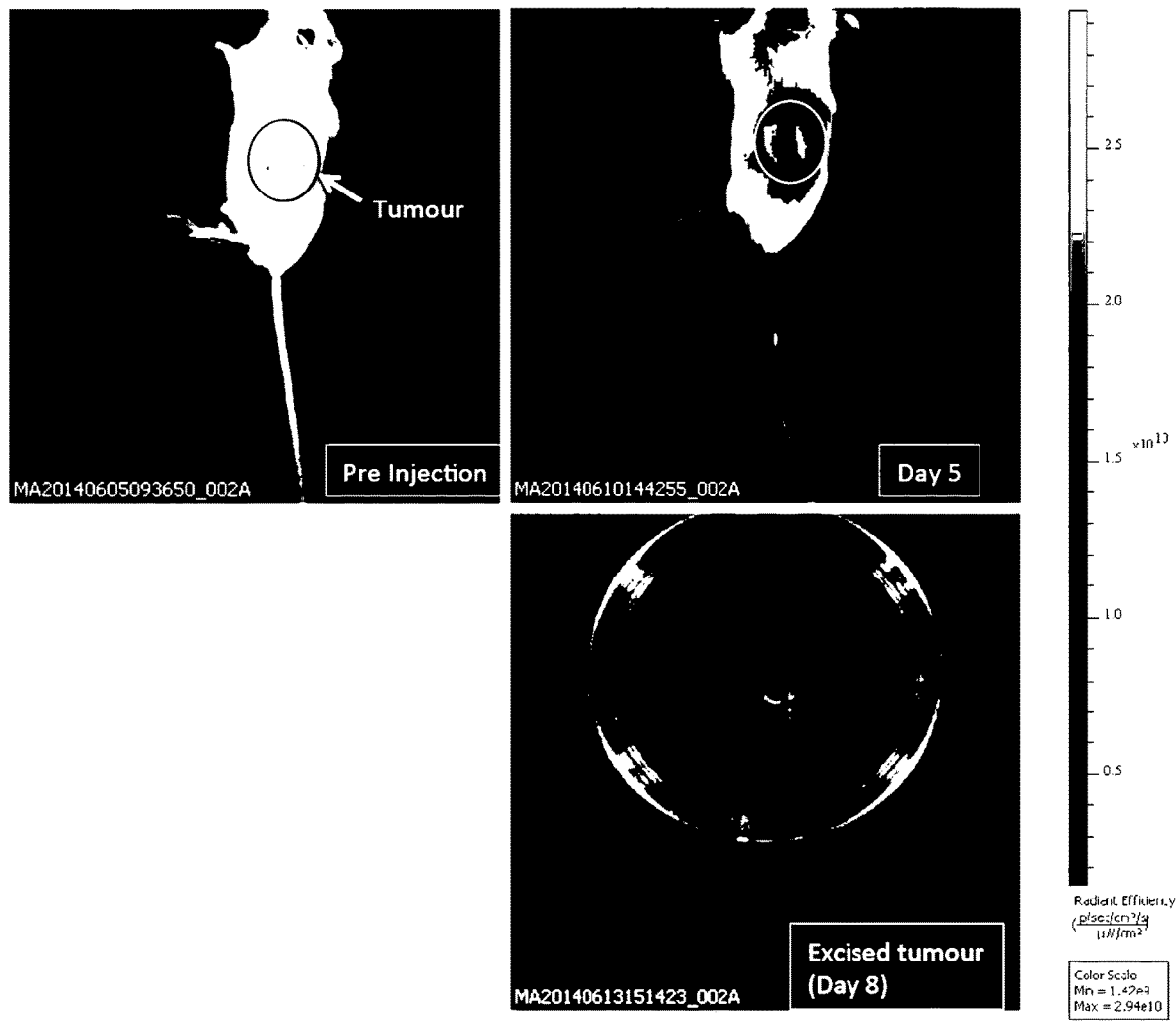
FIG. 14 is a photographic representation showing whole animal imaging of a mouse administered IN3LSA. One mouse with an established tumor (volume ~900 mm$^3$) was administered a single intravenous injection of Cy5.5 labeled IN3LSA at a dose of 20 mg/kg. The image shows the animal pre-injection, as well as 5 days post-injection in which signal associated with the oligomer compound can be clearly observed. Also shown is the excised tumor at day 8 post injection.

Uptake of oligomer compounds in the tumor site was investigated following intraperitoneal and intravenous delivery, by injecting a fluorescently labeled IN3LSA oligomer and monitoring the mice for 7 days. As shown in FIG. 13, the fluorescence signal was not detected following i.p. injections. However, the signal following i.v. injections was several log scales higher at the tumor site and importantly, the signal persisted for seven days post injection, suggesting that the LSA oligomer selectively accumulates at the tumor site. These results are consistent with whole mouse imaging analysis shown in FIG. 14.

Example 8

Figure 15:
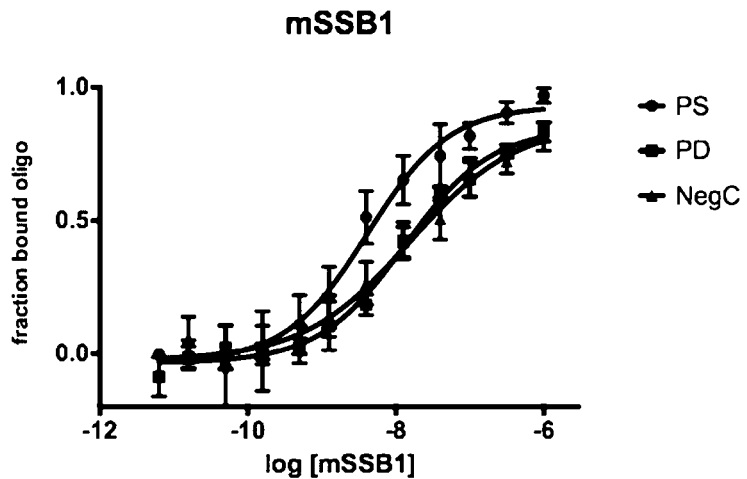
FIG. 15 is a graphic representation of hSSB1 EMSAs showing increasing concentrations of hSSB1 protein vs. 5 nM of FAM-labeled LSA_In3E3 sequence in either phosphorothioate (PS) or phosphodiester (PD) chemistry, or negative control sequence (Neg_C) in phosphorothioate chemistry. Graphs represent quantification of at least triplicate experiments, expressed as the fraction of oligomer compound bound to the protein. Purified protein was incubated with 5 nM of labeled oligomer compound for 15 min at 37° C. in a buffer consisting of 10 mM Tris-HCl (pH7.5), 100 mM KCl, 0.01% IGEPAL, 1 mM EDTA and 50 ng/µL BSA. Samples were separated by electrophoresis on a 15% PAGE gel in TBE buffer for 120 min at 80V at 4° C.
Figure 16:
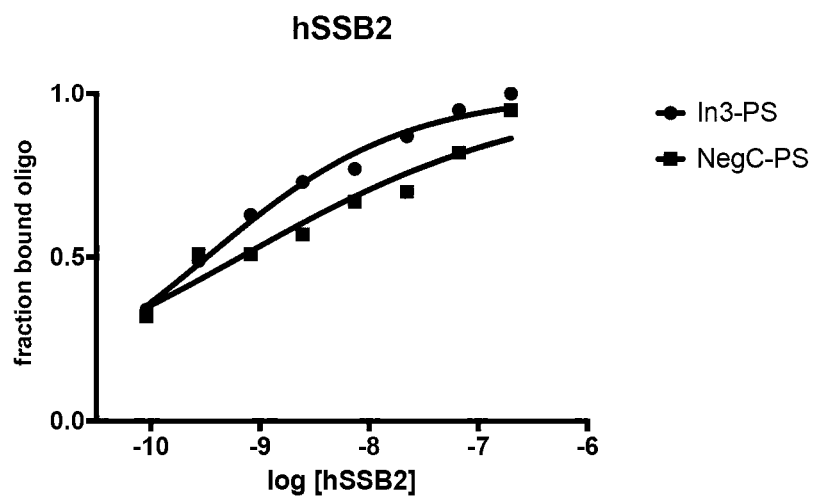
FIG. 16 is a graphic representation of a single EMSA showing increasing concentrations of hSSB2 protein vs. 5 nM of FAM-labeled LSA_In3E3 sequence or negative control sequence (Neg_C) in phosphorothioate chemistry. Graphs represent the fraction of oligo bound to the protein. Purified protein was incubated with 5 nM of labeled oligo for 15 min at 37° C. in a buffer consisting of 10 mM Tris-HCl (pH7.5), 100 mM KCl, 0.01% IGEPAL, 1 mM EDTA and 50 ng/µL BSA. Samples were separated by electrophoresis on a 15% PAGE gel in TBE buffer for 120 min at 80V at 4° C.

Oligomer Compounds Act Through the Oligonucleotide/Oligosaccharide-Binding (OB) Fold-Containing Family of Proteins FAM-labeled non-targeting PS compound, LSA_In3E3, PD compounds, DNA_In3E3 and RNA_In3E3, and a negative control oligomer compound, NEGC, were incubated separately with purified mouse SSB1 (mSSB1), hSSB1 and human SSB2 (hSSB2) proteins. Bound and free oligomers were separated by native gel electrophoresis and as shown in FIGS. 15 and 16 and TABLES 9-10, the OB-fold proteins, mSSB1, hSSB1 and hSSB2, retarded the migration of the tumor-modulating oligomer (LSA_In3E3) at a much greater level than the non-toxic oligomers (DNA_In3E3, RNA_In3E3 and NEGC), indicating that tumor-modulating oligomer has significantly higher affinity to the OB-fold proteins than the non-toxic oligomers.

TABLE 9

| KD (nM) mSSB1 | | |
| --- | --- | --- |
| LSA_In3E3 | DNA_In3E3 | NegC |
| 4.133 | 13.12 | 15.4 |

TABLE 9 summarizes the results of triplicate EMSA experiments performed with mSSB1 and three different oligomer compounds, as set out below. Dissociation constants for individual mSSB1:oligomer interactions are shown ($K_D$, concentration of protein at which 50% of oligonucleotide is bound to the protein at equilibrium).

Oligomer compounds used for TABLE 9 were as follows:

```
a) LSA_IN3E3 =
                                            [SEQ ID NO: 5]
mC*mC*mA*mG*mU*mG*mA*mG*mC*mC*mG*mG*mA*mC*mU*mU* mG*mC*mC*Mu wherein m represents a 2'-Omethyl modified base, and * represents a PS internucleoside linkage;

b) DNA_In3E3 =
                                          [SEQ ID NO: 306]
dCdCdAdGdUdGdAdGdCdCdGdGdAdCdUdUdGdCdCdU, wherein d represents a deoxyribonucleoside, and the oligomer comprises a PD internucleoside linkage;
and c) NEGC =
                                            [SEQ ID NO: 4]
mC*mU*mC*mA*mU*mU*mC*mC*mU*mA*mC*mC*mG*mA*mC*mA* mC*mC*mC*mC, wherein m represents a 2'-Omethyl modified base, and * represents a PS internucleoside linkage.
```

TABLE 10

| KD (nM) hSSB1 | | | |
| --- | --- | --- | --- |
| LSA_IN3E3 | DNA_In3E3 | RNA_In3E3 | NegC (PS) |
| 3.291 | 13.49 | 136.8 | 10.02 |

TABLE 10 summarizes the results of triplicate EMSA experiments performed with hSSB1 and four different oligomer compounds, as set out below. Dissociation constants for individual mSSB1:oligomer interactions are shown ($K_D$, concentration of protein at which 50% of oligonucleotide is bound to the protein at equilibrium).

Oligomer compounds used for TABLE 10 were as follows:

```
a) LSA_IN3E3 =
                                            [SEQ ID NO: 5]
mC*mC*mA*mG*mU*mG*mA*mG*mC*mC*mG*mG*mA*mC*mU*mU* mG*mC*mC*Mu wherein m represents a 2'-Omethyl modified base, and * represents a PS internucleoside linkage;

b) DNA_In3E3 =
                                          [SEQ ID NO: 306]
dCdCdAdGdUdGdAdGdCdCdGdGdAdCdUdUdGdCdCdU, wherein d represents a deoxyribonucleoside, and the oligomer comprises a PD internucleoside linkage;
and c) RNA_In3E3 =
                                          [SEQ ID NO: 307]
rCrCrArGrUrGrArGrCrCrGrGrArCrUrUrGrCrCrU, wherein r represents a ribonucleoside, and the oligomer comprises a PD internucleoside linkage;

c) NEGC =
                                            [SEQ ID NO: 4]
mC*mU*mC*mA*mU*mU*mC*mC*mU*mA*mC*mC*mG*mA*mC*mA* mC*mC*mC*mC, wherein m represents a 2'-Omethyl modified base, and * represents a PS internucleoside linkage.
```

Example 9

Figure 17:
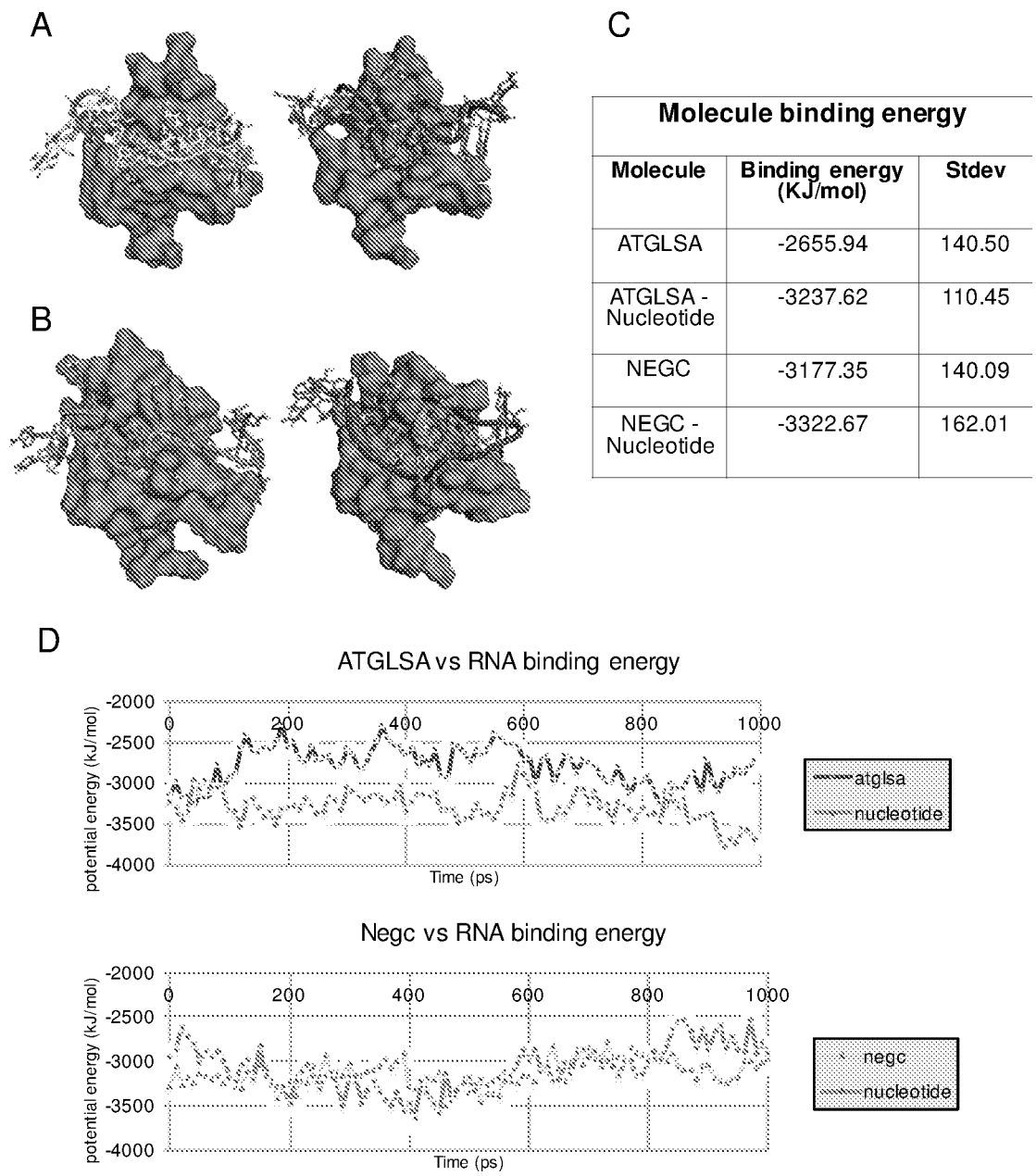
FIG. 17 is a schematic and graphic representation illustrating that molecular simulation of hSSB1 binding to oligomer compounds can be used to screen for sequences with a greater hSSB1 binding affinity. A. ATGLSA oligomer in yellow and its unmodified RNA sequence in blue. B. NEGC oligomer in pink and its unmodified RNA sequence in blue. C. Average SSB-oligomer compound binding energies generated from a stable conformation between 200 to 500 ps. D. Binding energies of each oligo relative to its unmodified RNA nucleotide sequence over a 1 ns simulation.

Molecular Simulation to Screen for Oligomers with Greater HSSB1 Binding Affinity Oligomer compounds with greater binding affinity to hSSB1 may also be determined using Atomistic Molecular Dynamics (AMD) simulations with software such as OpenMM by Symbios. Simulations of hundreds of query sequences can be performed and free energy of binding determined for each. FIG. 17 demonstrates that ATGLSA (killing sequence) binds hSSB1 with a lower free energy of binding than the NegC (non killing sequence) to hSSB1 providing insight about the difference in lethality between the sequences and demonstrating the application of AMD simulations for further drug development. Such simulation software can be used to screen for oligomer compounds with a lower free energy of binding and thus a greater binding affinity for hSSB1, providing a shortlist of improved drug sequences which may have increased lethality and decreased off target effects.

FIGS. 17A and B show that human hSSB1 demonstrates a greater affinity for the phosphorothioate backbone of the NEGC oligo than for the nucleotides themselves, this leaves the bases solvent exposed. hSSB1 has a more favorable interaction with ATGLSA which leaves less of the nucleotides solvent exposed. When exposed to solvent these nucleotides will interact with water, and this leaves the binding groove open to solvent which will weaken the interaction with the oligomer. FIGS. 17C and D shows that it takes less energy for ATGLSA to maintain its interaction with the binding groove of SSB1, demonstrating a binding energy 521 KJ/mol lower than NEGC. How this binding energy changes over the simulation can be seen in FIG. 17D, which demonstrates a consistently lower binding energy for ATGLSA than its nucleotide sequence, while NEGC has a binding energy that almost matches its unmodified sequence.

Example 10

Figure 18:
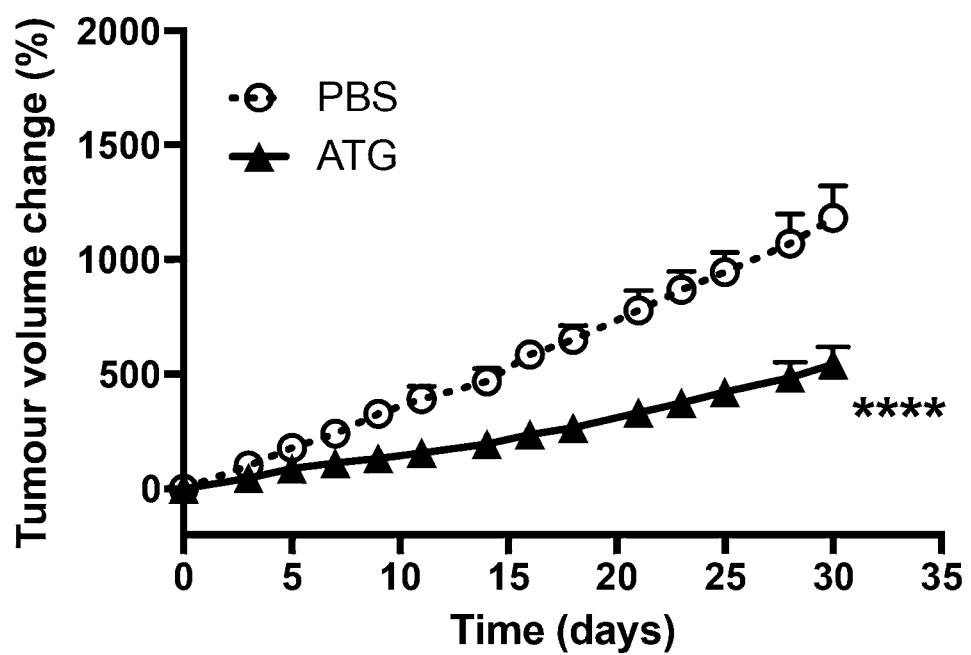
FIG. 18 is a graphic representation showing that ATGLSA (ATG) oligomer compound suppresses tumor growth in a lung cancer xenograft model. Male SCID mice bearing H460 lung cancer subcutaneous tumors were treated with vehicle control PBS (open dots, n=7) or ATGLSA oligomer (dark triangles, n=8) at 80 mg/kg, twice weekly for four weeks via intravenous tail vein/retro orbital injection. Graph shows the average percentage change (+/−sem) in tumor volume during the course of the treatment ****: P-value <0.0001 in a Two-way ANOVA.

Oligomer Compounds Inhibit Tumor Cell Growth In Vivo in a Lung Cancer Xenograft Model Non-targeting oligomers were tested in vivo in a lung cancer xenograft model using the H460 lung cancer cell line. Specifically, 6-wk old SCID male mice (Animal Resources Centre—ARC, Canning Vale, Wash.) were injected sub-cutaneously in the flank with 2 million Luciferase-expressing H460 lung cancer cells. Mice were subsequently monitored for tumor growth by palpation, caliper measurements and measure of the tumor bioluminescence signal with the IVIS scanning system. When the tumor volume reached an average of 50 mm$^3$, mice were randomly incorporated into either the PBS (vehicle control) group or the tumor-modulating non-targeting oligomer ATGLSA group (n=8 mice/treatment group). Oligomer ATGLSA was diluted in PBS (Life Technologies) and administered at the dose of 80 mg/kg via intravenous (i.v.) injection twice weekly for four weeks (for a total of 8 injections). During the course of the treatment, mice were monitored for weight and tumor growth by caliper measurements (volume calculated from the formula V=A/2×B2, with A=length >B=width in mm) and IVIS scan for bioluminescence signal. A statistically significant retardation of tumor growth was observed (see, FIG. 18) for the ATGLSA (ATG) treated mice, as compared to PBS treated mice, which demonstrate that these non-targeting oligomers had chemostatic effect in a lung cancer xenograft model.

Figure 19:
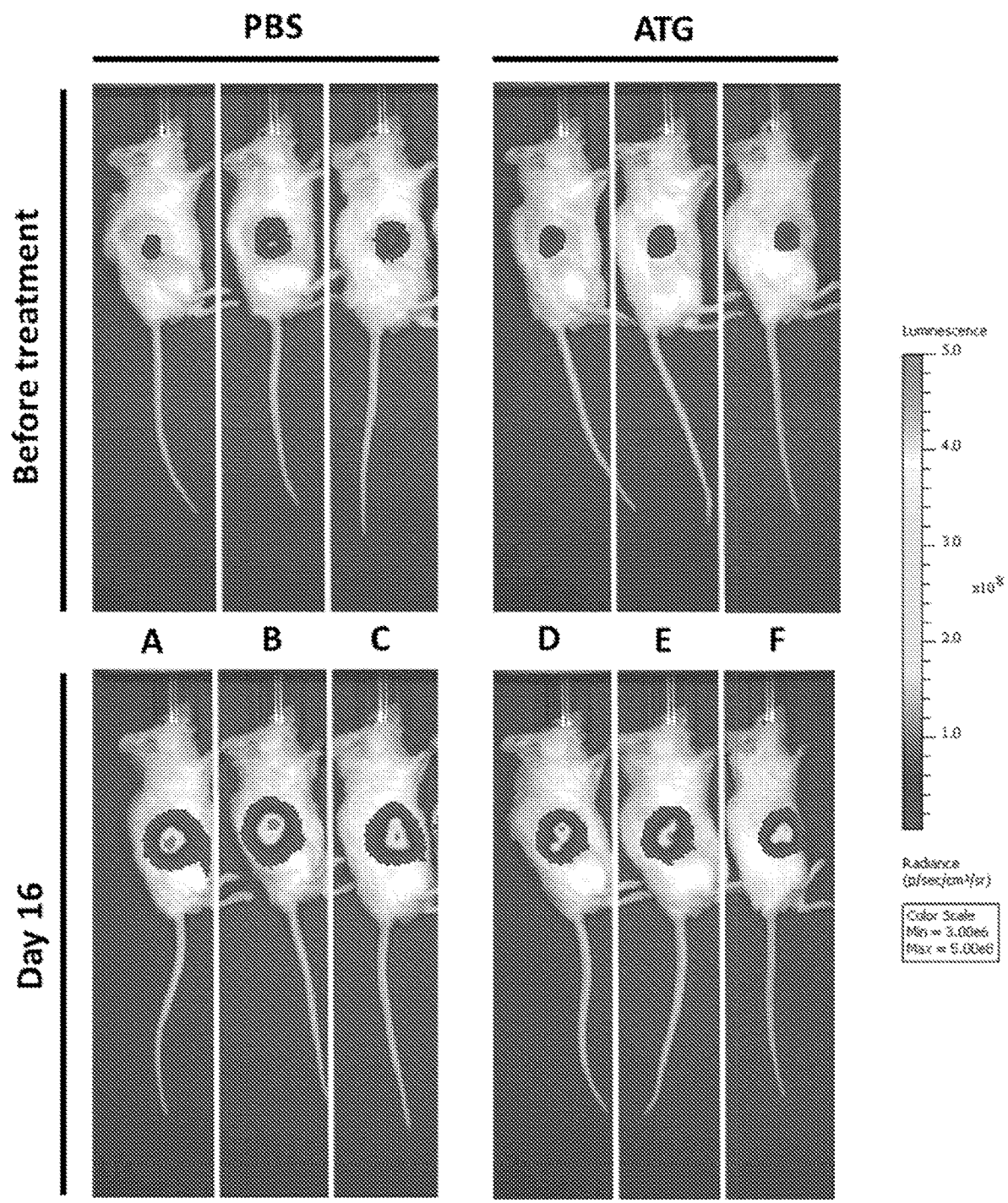
FIG. 19 is a photographic representation showing bioluminescence imaging of parental lung H460 xenograft treated with control PBS or ATGLSA (ATG) oligomer compound. Mouse tumor bioluminescence signal from cancer cells luciferase activity was measured before start and at 16 days of treatment. SCID males received a 200 µL intraperitoneal injection of D-luciferine 15 min before signal acquisition with the IVIS system. Three representative mice are shown for PBS treated group (A, B and C), and ATGLSA (ATG) treated group (D, E and F) before (top panels) and at 16 days of treatment (bottom panels). Heat signal represents the luminescence scale.

This difference in the tumor volume was confirmed by luciferase activity of the tumors. IVIS scans at day 14 of the treatment shows a lower bioluminescence signal for the ATGLSA treated group compared to the control PBS group (FIG. 19).

Figure 20:
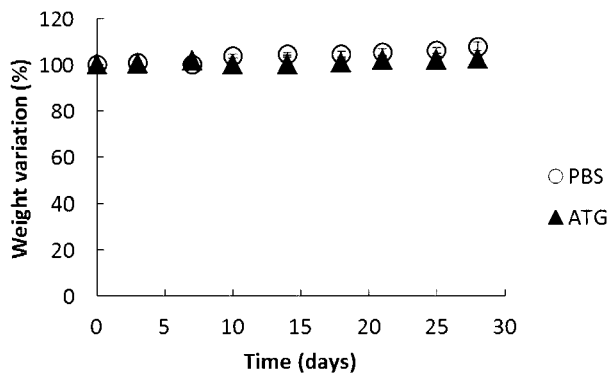
FIG. 20 is a graphic representation showing weight monitoring of control PBS vs ATGLSA (ATG) treated mice (parental H460 tumor model). Each animal was weighed twice weekly during the course of the study. Graph represents the average percentage of weight variation (+/−sem) as compared to the first day of treatment for PBS treated cohort (open dots) and ATGLSA (ATG) treated cohort (black triangles).

During the course of treatment, mice weight was monitored twice weekly. No significant weight loss, or loss of condition was observed in the animals treated with PBS or ATGLSA, demonstrating that these non-targeting oligomers had no significant toxicity in treated mice (see, FIG. 20).

Example 11

Figure 21:
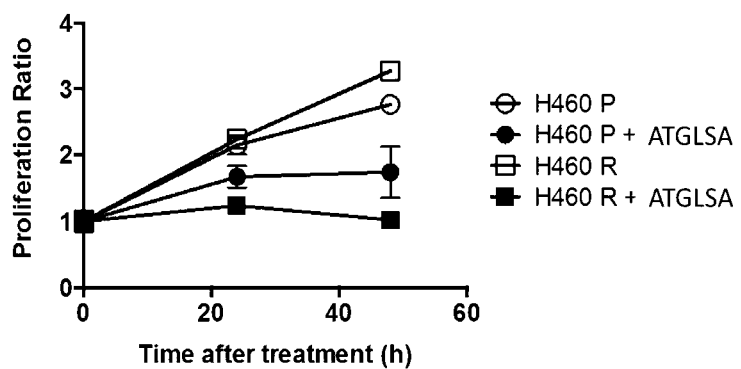
FIG. 21 is a graphic representation showing parental and cisplatin resistant lung H460 cancer cells proliferation after treatment with ATGLSA oligomer compound. H460 Parental (H460 P, dots) cells and cisplatin resistant (H460 R, squares) cells were treated with control PBS (open symbols) vs 100 nM ATGLSA (dark symbols). Proliferation ratio is calculated by cell confluency at 24 and 48 h reported to the initial cell confluency (+/−sem).

Oligomer Compounds Inhibit Tumor Cell Growth in Cisplatin-Resistant Lung Cancer In Vitro The cisplatin-sensitive H460 lung cancer cell line was exposed to escalating doses of cisplatin over a three-month period to create a cisplatin-resistant cell line. When tested in vitro, by measuring cell proliferation over 48 hours post addition of the non-targeting oligomer ATGLSA (100 nM) using the Incucyte zoom system, ATGLSA was more efficient at killing the cisplatin-resistant H460 cell line than the parental H460 cell line (FIG. 21).

Example 12

Figure 22:
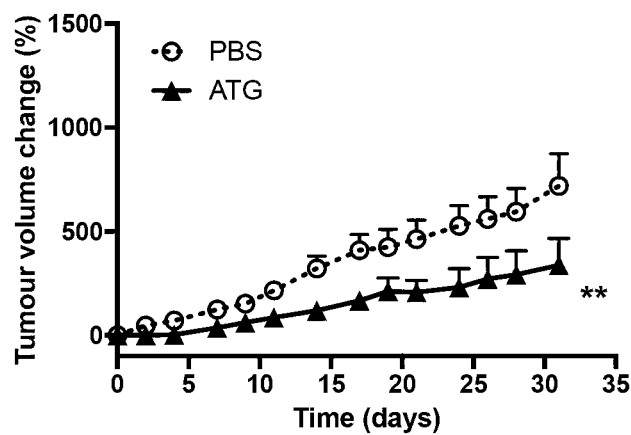
FIG. 22 is a graphic representation showing that ATGLSA (ATG) oligomer compound suppresses tumor growth in a cisplatin resistant lung cancer xenograft model. Male SCID mice bearing subcutaneous H460 cisplatin resistant tumors were treated with vehicle control PBS (open dots, n=6) or with ATGLSA oligomer (ATG, black triangles, n=6) at 80 mg/kg, twice weekly for four weeks via intravenous tail vein/retro orbital injection. Graph shows the average percentage change in tumor volume (+/−sem) during the course of the treatment. **: P-value <0.01 in a Two-way ANOVA.

Oligomer Compounds Inhibit Tumor Cell Growth in Cisplatin-Resistant Lung Cancer In Vivo Non-targeting oligomers were tested in vivo in a lung cancer xenograft model using the cisplatin-resistant H460 lung cancer cell line. Specifically, 6-wk old SCID male mice (Animal Resources Centre—ARC, Canning Vale, Wash.) were injected sub-cutaneously in the flank with 2 million Luciferase-expressing cisplatin-resistant H460 lung cancer cells. Mice were subsequently monitored for tumor growth by palpation, caliper measurements and measure of the tumor bioluminescence signal with the IVIS scanning system. When the tumor volume reached an average of 50 mm$^3$, mice were randomly incorporated into either the PBS (vehicle control) group or the tumor-modulating non-targeting oligomer ATGLSA group (n=8 mice/treatment group). Oligonucleotide ATGLSA was diluted in PBS (Life Technologies) and administered at the dose of 80 mg/kg via intravenous (i.v.) injection twice weekly for four weeks (for a total of 8 injections). During the course of the treatment, mice were monitored for weight and tumor growth by caliper measurements (volume calculated from the formula V=A/2×B$^2$, with A=length>B=width in mm) and IVIS scan for bioluminescence signal. A statistically significant retardation of tumor growth was observed (see, FIG. 22) for the ATGLSA (ATG) treated mice, as compared to PBS treated mice, which demonstrate that these non-targeting oligomers have chemostatic effect in a cisplatin-resistant lung cancer xenograft model.

Figure 23:
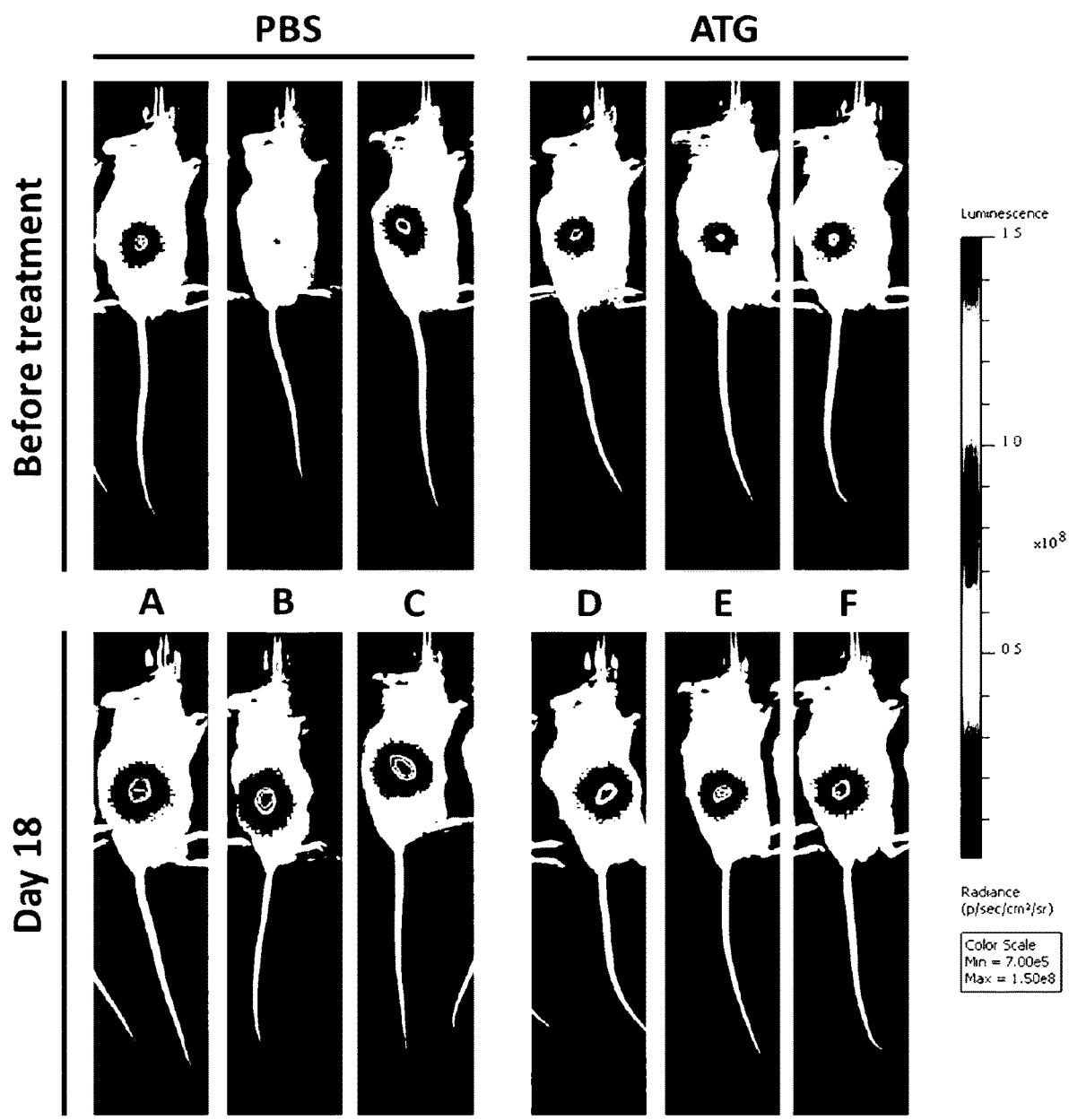
FIG. 23 is a photographic representation showing bioluminescence imaging of cisplatin-resistant lung H460 xenograft treated with control PBS or ATGLSA (ATG) oligomer compound. Mouse tumor bioluminescence signal from cancer cells luciferase activity was measured before and at 18 days of treatment. SCID males received a 200 µL intraperitoneal injection of D-luciferine 15 min before signal acquisition with the IVIS system. Three representative mice are shown for PBS treated group (A, B and C), and ATGLSA (ATG) treated group (D, E and F) before (top panels) and at 16 days of treatment (bottom panels). Heat signal represents the luminescence scale.

The tumor volume difference was also validated by the luciferase activity of the tumor cells, as measured by the bioluminescence signal for each tumor with IVIS scan (FIG. 23).

Figure 24:
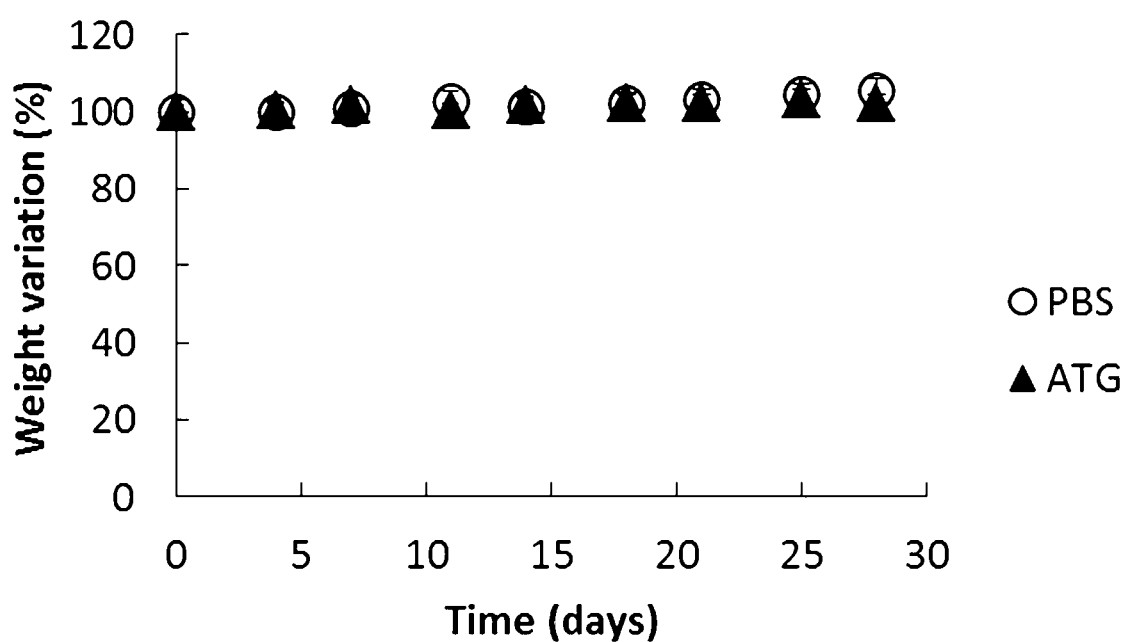
FIG. 24 is a graphic representation showing weight monitoring of control PBS vs ATGLSA (ATG) treated mice of cisplatin resistant H460 tumor model. Each animal was weighed twice weekly during the course of the study. Graph represents the average percentage of weight variation (+/−sem) as compared to the first day of treatment for PBS treated cohort (open dots) and ATGLSA (ATG) treated cohort (black triangles).

The present inventors did not observe any weight loss in the ATGLSA treated cohort over the treatment time, nor did they discern any difference in behavior or condition between the animals treated with PBS or ATGLSA. These results are in line with the parental H460 xenograft experiment (FIG. 24).

Example 13

Figure 25:
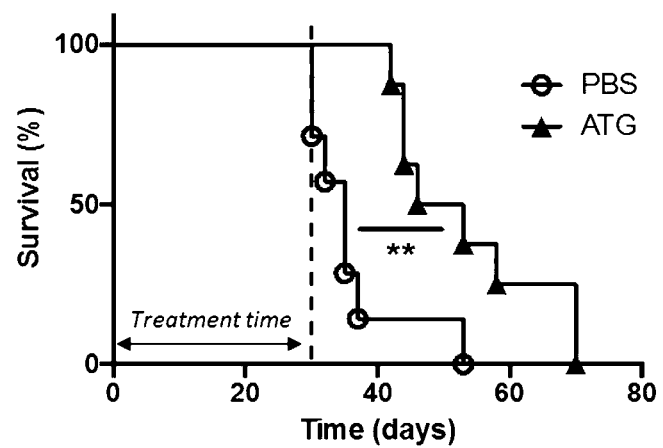
FIG. 25 is a Kaplan-Meier graph showing a long term assessment of ATGLSA (ATG) treatment effect on cisplatin-sensitive H460 lung xenograft. Male SCID mice were monitored from the beginning of the treatment with ATGLSA (80 mg/kg) until their tumor reach the maximum final volume of 1000 mm$^3$ (determined by calipers measurements). ** P-value <0.01 in Rank-Log analysis.

Long Term Effect of ATGLSA in Cisplatin-Sensitive and Cisplatin-Resistant Lung Cancer Models In Vivo To evaluate the long term effect of the ATGLSA treatment, tumor growth and mice weight were monitored post cessation of the 4-week treatment, until the tumors reached a final volume of 1000 mm$^3$ and generated a Kaplan-Meier graph. In the cisplatin-sensitive H460 model, the four-week ATGLSA treatment resulted in a statistically significant 41% (14 days) increase of the mice median survival in the ATGLSA treated group, as compared to control group (FIG. 25 and Table 11).

TABLE 11

MEDIAN SURVIVAL OF SCID MALES WITH CISPLATIN-SENSITIVE H460 AND CISPLATIN-RESISTANT LUNG H460 TUMOURS TREATED WITH CONTROL PBS VS ATGLSA

| Cancer model | | PBS | ATGLSA |
| --- | --- | --- | --- |
| Lung H460 Cisplatin-sensitive | Median survival (days) | 35 | 49.5 |
| | P-value (Rank-Log test) | | 0.0051 |
| Lung H460 Cisplatin-resistant | Median survival (days) | 48 | 66 |
| | P-value (Rank-Log test) | | 0.2032 |

Figure 26:
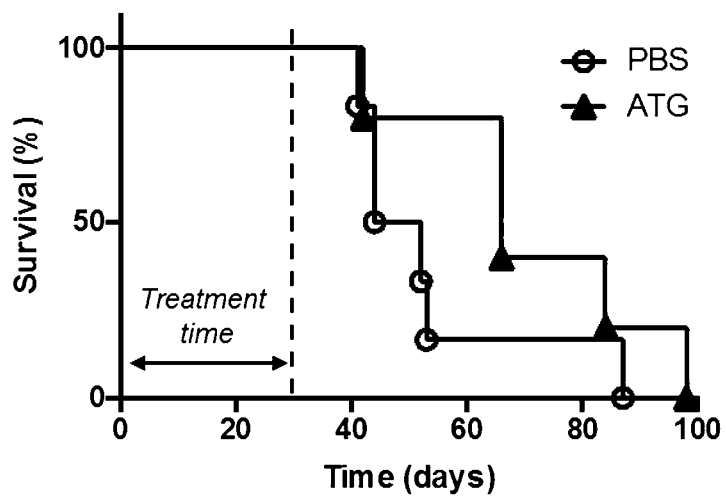
FIG. 26 is a Kaplan-Meier graph showing a long term assessment of ATGLSA (ATG) treatment effect on Cisplatin-resistant H460 lung xenograft. Male SCID mice were monitored from the beginning of the treatment with ATGLSA (80 mg/kg) until their tumor reach the final maximum volume of 1000 mm3 (determined by calipers measurements).

In the cisplatin-resistant H460 model, a 37.5% (18 days) increased median survival in the ATGLSA treated cohort was observed (FIG. 26), however, the difference between ATGLSA and the PBS control group was not statistically significant in a Rank-Log test (Table 11).

Example 14

Figure 27:
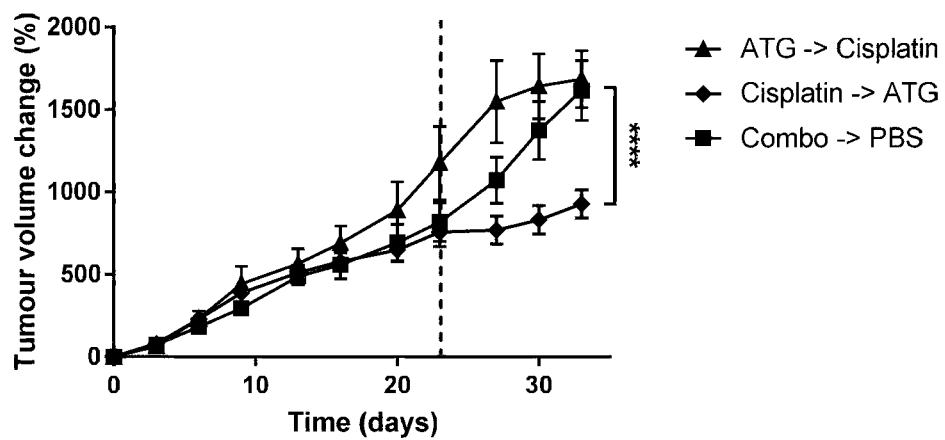
FIG. 27 is a graphic representation showing that ATGLSA (ATG) oligomer compound reduces tumor growth in lung tumor xenograft model. Male SCID mice bearing subcutaneous tumors were treated with ATGLSA oligomer (ATG, green triangles, n=5), cisplatin (black diamonds) or combination of ATGLSA+Cisplatin (red squares) for 3 weeks (dashed line). Treatments for each group were switched at week 4: Combination animals were treated with control vehicle PBS, ATGLSA animals were treated with cisplatin, and Cisplatin animals were treated with ATGLSA. Graph shows the average percentage change (+/−sem) in tumor volume during the course of the treatment ****: P-value <0.0001 in a Two-way ANOVA.
Figure 28:
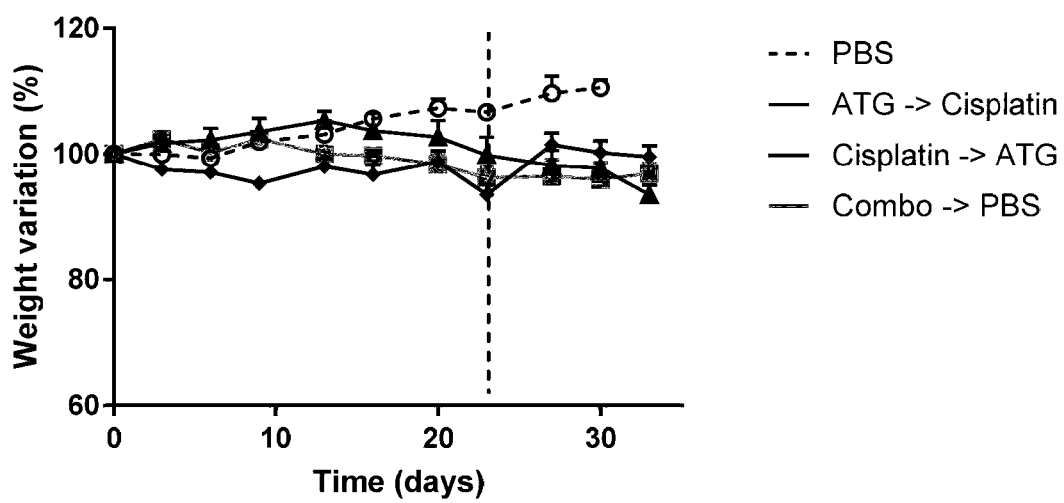
FIG. 28 is a graphic representation showing weight monitoring of control PBS, ATGLSA (ATG), Cisplatin and Combination of ATGLSA+Cisplatin (Combo) treated mice in H460 tumor model. Each animal was weighed twice weekly during the course of the study. Graph represents the average percentage of weight variation (+/−sem) as compared to the first day of treatment for PBS treated cohort (open blue dots), ATGLSA (ATG) then Cisplatin treated cohort (green triangles), Cisplatin then ATGLSA treated cohort (black diamonds) and combined ATGLSA+Cisplatin (Combo) then PBS treated cohort (red squares).

ATGLSA Combination with Cisplatin Treatment in an In Vivo Lung Cancer Xenograft Model Non-targeting oligomers were tested in vivo in a lung cancer xenograft model using the cisplatin-sensitive H460 lung cancer cell line. Specifically, 6-wk old SCID male mice (Animal Resources Centre—ARC, Canning Vale, Wash.) were injected sub-cutaneously in the flank with 2 million Luciferase-expressing cisplatin-resistant H460 lung cancer cells. Mice were subsequently monitored for tumor growth by palpation, caliper measurements and measure of the tumor bioluminescence signal with the IVIS scanning system. When the tumor volume reached an average of 50 mm$^3$ (92% tumor intake), mice were randomly incorporated into either PBS control group, ATGLSA group, cisplatin group, or the combination ATGLSA+Cisplatin group. Oligonucleotide ATGLSA was diluted in PBS (Life Technologies) and administered at the dose of 80 mg/kg via intravenous (i.v.) injection twice weekly. Cisplatin (in saline suspension at 1 mg/kg, Hospira) was injected once a week by intra-peritoneal injection (4 mg/kg). Combination treatment group received 2×ATGLSA (80 mg/kg) i.v injections and one cisplatin (4 mg/kg) i.p injection per week. Following 3 weeks of treatment all treated cohorts has a significantly lower tumor growth compared to PBS however, there was no significant difference in tumor growth between the ATGLSA (ATG), cisplatin, and combination ATGLSA+Cisplatin (Combo) treated cohorts (FIG. 27). At 3 weeks post treatment, the present inventors switched treatment between the groups (FIG. 28, dashed line): ATGLSA treated mice were switched to Cisplatin (4 mg/kg, once a week, i.p), Cisplatin treated mice were switched to ATGLSA (80 mg/kg, i.v, twice a week), and Combination ATGLSA+Cisplatin mice (Combo) became a control PBS group (150 µL PBS, i.v, twice a week). We observed a significant tumor growth retardation in the 'Cisplatin first/ATGLSA second' treated mice, with no tumor growth for the first days of treatment.

The weight of each animal was also monitored to check if the treatment could induce any acute toxicity in vivo. It was observed that while the ATGLSA (ATG) compound had no significant impact on mouse weight loss at 3 weeks of treatment as compared to PBS, a significant loss of weight was observed in the cisplatin treated mice. This suggests that ATGLSA, while slowing tumor growth at the same rate as cisplatin, did not cause obvious adverse toxicity to the animal. Moreover, when switching cisplatin treatment to ATGLSA, a statistically significant increase in mice weight was observed straight after the switch. This increase remained stable for the rest of the treatment. Overall, the data show that ATGLSA has chemostatic effect on lung cancer tumors and lung cancer tumors that have developed resistance to cisplatin. The data also show that a sequential treatment with ATGLSA post cisplatin is more efficient than both drugs administered at the same time.

The disclosure of every patent, patent application, and publication cited herein is hereby incorporated herein by reference in its entirety.

The citation of any reference herein should not be construed as an admission that such reference is available as "Prior Art" to the instant application.

Throughout the specification the aim has been to describe the preferred embodiments of the invention without limiting the invention to any one embodiment or specific collection of features. Those of skill in the art will therefore appreciate that, in light of the instant disclosure, various modifications and changes can be made in the particular embodiments exemplified without departing from the scope of the present invention. All such modifications and changes are intended to be included within the scope of the appended claims.

SEQUENCE LISTING (307 sequences)

SEQ ID NO: 1 - RNA, 20 nt, Artificial Sequence
  DKLS478030
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
ccagugagccggacuugccu

SEQ ID NO: 2 - RNA, 20 nt, Artificial Sequence
  DKLS230778
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): gm
  misc_feature (19)..(20): Phosphorothioate bond
  modified_base (20)..(20): gm
cagaggcagcaguacgacgg

SEQ ID NO: 3 - RNA, 20 nt, Artificial Sequence
  DKLS170415
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): gm
gugcauggaaucacggagug

SEQ ID NO: 4 - RNA, 20 nt, Artificial Sequence
  DKLS525146
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): am
  misc_feature (4)..(5): Phosphorothioate bond
  modified_base (5)..(5): um
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): cm
  modified_base (9)..(9): um
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): am
  misc_feature (16)..(17): Phosphorothioate bond
  modified_base (17)..(17): cm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): cm
cucauuccuaccgacacccc

SEQ ID NO: 5 - RNA, 20 nt, Artificial Sequence
  DKLS394649
  modified_base (1)..(1): cm
  modified_base (2)..(2): cm
  modified_base (3)..(3): am
  modified_base (4)..(4): gm
  modified_base (5)..(5): um
  modified_base (6)..(6): gm
  modified_base (7)..(7): am
  modified_base (8)..(8): gm
  modified_base (9)..(9): cm
  modified_base (10)..(10): cm
  modified_base (11)..(11): gm
  modified_base (12)..(12): gm
  modified_base (13)..(13): am
  modified_base (14)..(14): cm
  modified_base (15)..(15): um
  modified_base (16)..(16): um
  modified_base (17)..(17): gm
  modified_base (18)..(18): cm
  modified_base (19)..(19): cm
  modified_base (20)..(20): um
ccagugagccggacuugccu

SEQ ID NO: 6 - RNA, 18 nt, Artificial Sequence
  DKLS506891
  misc_feature (1)..(2): Phosphorothioate bond
  misc_feature (2)..(3): Phosphorothioate bond
  misc_feature (3)..(4): Phosphorothioate bond
  misc_feature (4)..(5): Phosphorothioate bond
  misc_feature (5)..(6): Phosphorothioate bond
  misc_feature (6)..(7): Phosphorothioate bond
  misc_feature (7)..(8): Phosphorothioate bond
  misc_feature (8)..(9): Phosphorothioate bond
  misc_feature (9)..(10): Phosphorothioate bond
  misc_feature (10)..(11): Phosphorothioate bond
  misc_feature (11)..(12): Phosphorothioate bond
  misc_feature (12)..(13): Phosphorothioate bond
  misc_feature (13)..(14): Phosphorothioate bond
  misc_feature (14)..(15): Phosphorothioate bond
  misc_feature (15)..(16): Phosphorothioate bond
  misc_feature (16)..(17): Phosphorothioate bond
  misc_feature (17)..(18): Phosphorothioate bond
ucucccagcgugcgccau

SEQ ID NO: 7 - RNA, 18 nt, Artificial Sequence
  DKLS371273
  misc_feature (1)..(2): Phosphorothioate bond
  misc_feature (2)..(3): Phosphorothioate bond
  misc_feature (3)..(4): Phosphorothioate bond
  misc_feature (4)..(5): Phosphorothioate bond
  misc_feature (5)..(6): Phosphorothioate bond
  misc_feature (6)..(7): Phosphorothioate bond
  misc_feature (7)..(8): Phosphorothioate bond
  misc_feature (8)..(9): Phosphorothioate bond
  misc_feature (9)..(10): Phosphorothioate bond
  misc_feature (10)..(11): Phosphorothioate bond
  misc_feature (11)..(12): Phosphorothioate bond
  misc_feature (12)..(13): Phosphorothioate bond
  misc_feature (13)..(14): Phosphorothioate bond
  misc_feature (14)..(15): Phosphorothioate bond
  misc_feature (15)..(16): Phosphorothioate bond
  misc_feature (16)..(17): Phosphorothioate bond
  misc_feature (17)..(18): Phosphorothioate bond
uaccgcgugcgacccucu

SEQ ID NO: 8 - RNA, 18 nt, Artificial Sequence
  DKLS658030
  misc_feature (1)..(2): Phosphorothioate bond
  misc_feature (2)..(3): Phosphorothioate bond
  misc_feature (3)..(4): Phosphorothioate bond
  misc_feature (4)..(5): Phosphorothioate bond
  misc_feature (5)..(6): Phosphorothioate bond
  misc_feature (6)..(7): Phosphorothioate bond
  misc_feature (7)..(8): Phosphorothioate bond
  misc_feature (8)..(9): Phosphorothioate bond
  misc_feature (9)..(10): Phosphorothioate bond
  misc_feature (10)..(11): Phosphorothioate bond
  misc_feature (11)..(12): Phosphorothioate bond
  misc_feature (12)..(13): Phosphorothioate bond
  misc_feature (13)..(14): Phosphorothioate bond
  misc_feature (14)..(15): Phosphorothioate bond
  misc_feature (15)..(16): Phosphorothioate bond
  misc_feature (16)..(17): Phosphorothioate bond
  misc_feature (17)..(18): Phosphorothioate bond
ucucccagcaugugccau

SEQ ID NO: 9 - RNA, 18 nt, Artificial Sequence
  DKLS696616
  modified_base (1)..(1): um
  misc_feature (1)..(2): Phosphorothioate bond
  modified_base (2)..(2): cm
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): um
  misc_feature (11)..(12): Phosphorothioate bond
  modified_base (12)..(12): gm
  misc_feature (12)..(13): Phosphorothioate bond
  modified_base (13)..(13): cm
  misc_feature (13)..(14): Phosphorothioate bond
  modified_base (14)..(14): gm
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): um
ucucccagcgugcgccau

SEQ ID NO: 10 - RNA, 18 nt, Artificial Sequence
  DKLS784557
  modified_base (1)..(1): um
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): cm
  misc_feature (13)..(14): Phosphorothioate bond
  modified_base (14)..(14): cm
  misc_feature (14)..(15): Phosphorothioate bond
  modified_base (15)..(15): cm
  misc_feature (15)..(16): Phosphorothioate bond
  modified_base (16)..(16): um
  misc_feature (16)..(17): Phosphorothioate bond
  modified_base (17)..(17): cm
  misc_feature (17)..(18): Phosphorothioate bond
  modified_base (18)..(18): um
uaccgcgugcgacccucu

SEQ ID NO: 11 - RNA, 18 nt, Artificial Sequence
  DKLS832163
  modified_base (1)..(1): um
  misc_feature (1)..(2): Phosphorothioate bond
  modified_base (2)..(2): cm
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): um
ucucccagcaugugccau

SEQ ID NO: 12 - RNA, 20 nt, Artificial Sequence
  DKLS629224
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): um
  misc_feature (6)..(7): Phosphorothioate bond
  modified_base (7)..(7): am
  misc_feature (7)..(8): Phosphorothioate bond
  modified_base (8)..(8): am
  misc_feature (8)..(9): Phosphorothioate bond
  modified_base (9)..(9): um
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): am
  misc_feature (16)..(17): Phosphorothioate bond
  modified_base (17)..(17): cm
  misc_feature (17)..(18): Phosphorothioate bond
  modified_base (18)..(18): um
  misc_feature (18)..(19): Phosphorothioate bond
  modified_base (19)..(19): um
  misc_feature (19)..(20): Phosphorothioate bond
  modified_base (20)..(20): am
ggucguaauacuuucacuua

SEQ ID NO: 13 - RNA, 20 nt, Artificial Sequence
  DKLS789189
  misc_feature (1)..(1): ZEN modification
  misc_feature (20)..(20): ZEN modification
cucauuccuaccgacacccc

SEQ ID NO: 14 - RNA, 20 nt, Artificial Sequence
  DKLS687764
  modified_base (1)..(1): um
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): cm
  misc_feature (14)..(15): Phosphorothioate bond
  modified_base (15)..(15): am
  misc_feature (15)..(16): Phosphorothioate bond
  modified_base (16)..(16): um
  misc_feature (16)..(17): Phosphorothioate bond
  modified_base (17)..(17): um
  misc_feature (17)..(18): Phosphorothioate bond
  modified_base (18)..(18): um
  misc_feature (18)..(19): Phosphorothioate bond
  modified_base (19)..(19): cm
  misc_feature (19)..(20): Phosphorothioate bond
  modified_base (20)..(20): um
ucaaggaagauggcauuucu

SEQ ID NO: 15 - RNA, 23 nt, Artificial Sequence
  DKLS687118
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): um
  misc_feature (6)..(7): Phosphorothioate bond
  modified_base (7)..(7): am
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): am
  misc_feature (12)..(13): Phosphorothioate bond
  modified_base (13)..(13): am
  misc_feature (13)..(14): Phosphorothioate bond
  modified_base (14)..(14): am
  misc_feature (14)..(15): Phosphorothioate bond
  modified_base (15)..(15): am
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): am
  misc_feature (20)..(21): Phosphorothioate bond
  modified_base (21)..(21): am
  misc_feature (21)..(22): Phosphorothioate bond
  modified_base (22)..(22): am
  misc_feature (22)..(23): Phosphorothioate bond
  modified_base (23)..(23): cm
cugccuaaguaaaaaguguaaac

SEQ ID NO: 16 - RNA, 23 nt, Artificial Sequence
  DKLS765774
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): um
  misc_feature (4)..(5): Phosphorothioate bond
  modified_base (5)..(5): cm
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): um
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): am
  misc_feature (15)..(16): Phosphorothioate bond
  modified_base (16)..(16): am
  misc_feature (16)..(17): Phosphorothioate bond
  modified_base (17)..(17): am
  misc_feature (17)..(18): Phosphorothioate bond
  modified_base (18)..(18): am
  misc_feature (18)..(19): Phosphorothioate bond
  modified_base (19)..(19): um
  misc_feature (19)..(20): Phosphorothioate bond
  modified_base (20)..(20): um
  misc_feature (20)..(21): Phosphorothioate bond
  modified_base (21)..(21): am
  misc_feature (21)..(22): Phosphorothioate bond
  modified_base (22)..(22): am
  misc_feature (22)..(23): Phosphorothioate bond
  modified_base (23)..(23): am
ccaucuguaauuacaaaauuaaa

SEQ ID NO: 17 - RNA, 23 nt, Artificial Sequence
  DKLS965031
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): am
  misc_feature (7)..(8): Phosphorothioate bond
  modified_base (8)..(8): cm
  misc_feature (8)..(9): Phosphorothioate bond
  modified_base (9)..(9): am
  misc_feature (9)..(10): Phosphorothioate bond
  modified_base (10)..(10): um
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): um
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): gm
  misc_feature (18)..(19): Phosphorothioate bond
  modified_base (19)..(19): gm
  misc_feature (19)..(20): Phosphorothioate bond
  modified_base (20)..(20): am
  misc_feature (20)..(21): Phosphorothioate bond
  modified_base (21)..(21): gm
  misc_feature (21)..(22): Phosphorothioate bond
  modified_base (22)..(22): um
  misc_feature (22)..(23): Phosphorothioate bond
  modified_base (23)..(23): cm
gaguaaacauucuguguggaguc

SEQ ID NO: 18 - DNA, 23 bp, Artificial Sequence
  DKLS934835
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (19)..(19): um
  misc_feature (19)..(20): Phosphorothioate bond
  modified_base (20)..(20): am
  misc_feature (20)..(21): Phosphorothioate bond
  modified_base (21)..(21): am
  misc_feature (21)..(22): Phosphorothioate bond
  modified_base (22)..(22): am
  misc_feature (22)..(23): Phosphorothioate bond
  modified_base (23)..(23): cm
cugcctaagtaaaaagtguaaac

SEQ ID NO: 19 - DNA, 23 bp, Artificial Sequence
  DKLS656574
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): um
  misc_feature (4)..(5): Phosphorothioate bond
  modified_base (5)..(5): cm
  misc_feature (5)..(6): Phosphorothioate bond
  modified_base (19)..(19): um
  misc_feature (19)..(20): Phosphorothioate bond
  modified_base (20)..(20): um
  misc_feature (20)..(21): Phosphorothioate bond
  modified_base (21)..(21): am
  misc_feature (21)..(22): Phosphorothioate bond
  modified_base (22)..(22): am
  misc_feature (22)..(23): Phosphorothioate bond
  modified_base (23)..(23): am
ccauctgtaattacaaaauuaaa

SEQ ID NO: 20 - DNA, 23 bp, Artificial Sequence
  DKLS799151
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): am
  misc_feature (5)..(6): Phosphorothioate bond
  modified_base (19)..(19): gm
  misc_feature (19)..(20): Phosphorothioate bond
  modified_base (20)..(20): am
  misc_feature (20)..(21): Phosphorothioate bond
  modified_base (21)..(21): gm
  misc_feature (21)..(22): Phosphorothioate bond
  modified_base (22)..(22): um
  misc_feature (22)..(23): Phosphorothioate bond
  modified_base (23)..(23): cm
gaguaaacattctgtgtggaguc

SEQ ID NO: 21 - RNA, 21 nt, Artificial Sequence
  DKLS354527
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): am
  misc_feature (10)..(11): Phosphorothioate bond
  modified_base (11)..(11): gm
  misc_feature (11)..(12): Phosphorothioate bond
  modified_base (12)..(12): um
  misc_feature (12)..(13): Phosphorothioate bond
  modified_base (13)..(13): cm
  misc_feature (13)..(14): Phosphorothioate bond
  modified_base (14)..(14): um
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): um
  misc_feature (18)..(19): Phosphorothioate bond
  modified_base (19)..(19): cm
  misc_feature (19)..(20): Phosphorothioate bond
  modified_base (20)..(20): am
  misc_feature (20)..(21): Phosphorothioate bond
  modified_base (21)..(21): um
cagcagcagagucuucaucau

SEQ ID NO: 22 - RNA, 18 nt, Artificial Sequence
  DKLS484655
  modified_base (1)..(1): um
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): um
  misc_feature (6)..(7): Phosphorothioate bond
  modified_base (7)..(7): am
  misc_feature (7)..(8): Phosphorothioate bond
  modified_base (8)..(8): um
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): am
  misc_feature (16)..(17): Phosphorothioate bond
  modified_base (17)..(17): um
  misc_feature (17)..(18): Phosphorothioate bond
  modified_base (18)..(18): um
ugugcuauucugugaauu

SEQ ID NO: 23 - RNA, 18 nt, Artificial Sequence
  DKLS463500
  modified_base (1)..(1): um
  misc_feature (1)..(2): Phosphorothioate bond
  modified_base (2)..(2): am
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): am
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): um
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): um
uaagcuguucuauguguu

SEQ ID NO: 24 - DNA, 15 bp, Artificial Sequence
  DKLS474224
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): cm
  misc_feature (12)..(13): Phosphorothioate bond
  modified_base (13)..(13): cm
  misc_feature (13)..(14): Phosphorothioate bond
  modified_base (14)..(14): gm
  misc_feature (14)..(15): Phosphorothioate bond
  modified_base (15)..(15): cm
gaggaactccgccgc

SEQ ID NO: 25 - RNA, 20 nt, Artificial Sequence
  DKLS370480
  modified_base (1)..(1): um
  misc_feature (1)..(2): Phosphorothioate bond
  modified_base (2)..(2): cm
  misc_feature (2)..(3): Phosphorothioate bond
  modified_base (3)..(3): um
  misc_feature (3)..(4): Phosphorothioate bond
  modified_base (4)..(4): um
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): um
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): am
  misc_feature (14)..(15): Phosphorothioate bond
  modified_base (15)..(15): am
  misc_feature (15)..(16): Phosphorothioate bond
  modified_base (16)..(16): cm
  misc_feature (16)..(17): Phosphorothioate bond
  modified_base (17)..(17): cm
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): um
ucuuauguuuccgaaccguu

SEQ ID NO: 26 - RNA, 20 nt, Artificial Sequence
  DKLS331584
  modified_base (1)..(1): um
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): um
  misc_feature (8)..(9): Phosphorothioate bond
  modified_base (9)..(9): um
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): cm
  misc_feature (15)..(16): Phosphorothioate bond
  modified_base (16)..(16): um
  misc_feature (16)..(17): Phosphorothioate bond
  modified_base (17)..(17): um
  misc_feature (17)..(18): Phosphorothioate bond
  modified_base (18)..(18): um
  misc_feature (18)..(19): Phosphorothioate bond
  modified_base (19)..(19): am
  misc_feature (19)..(20): Phosphorothioate bond
  modified_base (20)..(20): gm
ugcuaucuuaucaccuuuag

SEQ ID NO: 27 - RNA, 20 nt, Artificial Sequence
  DKLS693540
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): um
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): gm
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): um
  misc_feature (16)..(17): Phosphorothioate bond
  modified_base (17)..(17): cm
  misc_feature (17)..(18): Phosphorothioate bond
  modified_base (18)..(18): um
  misc_feature (18)..(19): Phosphorothioate bond
  modified_base (19)..(19): um
  misc_feature (19)..(20): Phosphorothioate bond
  modified_base (20)..(20): am
ggcgaaugagacuucucuua

SEQ ID NO: 28 - RNA, 20 nt, Artificial Sequence
  DKLS687192
  modified_base (1)..(1): um
  misc_feature (1)..(2): Phosphorothioate bond
  modified_base (2)..(2): cm
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): um
  misc_feature (12)..(13): Phosphorothioate bond
  modified_base (13)..(13): cm
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): am
  misc_feature (18)..(19): Phosphorothioate bond
  modified_base (19)..(19): um
  misc_feature (19)..(20): Phosphorothioate bond
  modified_base (20)..(20): gm
uccuggauccuucaccaaug

SEQ ID NO: 29 - RNA, 20 nt, Artificial Sequence
  DKLS684387
  modified_base (1)..(1): um
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): am
  misc_feature (7)..(8): Phosphorothioate bond
  modified_base (8)..(8): um
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): um
  misc_feature (16)..(17): Phosphorothioate bond
  modified_base (17)..(17): cm
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): um
ugucauauuccuggauccuu

SEQ ID NO: 30 - RNA, 20 nt, Artificial Sequence
  DKLS951212
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): um
gggacgcggcgcucggucau

SEQ ID NO: 31 - RNA, 21 nt, Artificial Sequence
  DKLS481254
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): am
  misc_feature (10)..(11): Phosphorothioate bond
  modified_base (11)..(11): gm
  misc_feature (11)..(12): Phosphorothioate bond
  modified_base (12)..(12): um
  misc_feature (12)..(13): Phosphorothioate bond
  modified_base (13)..(13): am
  misc_feature (13)..(14): Phosphorothioate bond
  modified_base (14)..(14): um
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): am
  misc_feature (17)..(18): Phosphorothioate bond
  modified_base (18)..(18): um
  misc_feature (18)..(19): Phosphorothioate bond
  modified_base (19)..(19): cm
  misc_feature (19)..(20): Phosphorothioate bond
  modified_base (20)..(20): am
  misc_feature (20)..(21): Phosphorothioate bond
  modified_base (21)..(21): um
cagcagcagaguauuuaucau

SEQ ID NO: 32 - RNA, 20 nt, Artificial Sequence
  DKLS491049
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): am
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): gm
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): gm
  misc_feature (16)..(17): Phosphorothioate bond
  modified_base (17)..(17): cm
  misc_feature (17)..(18): Phosphorothioate bond
  modified_base (18)..(18): um
  misc_feature (18)..(19): Phosphorothioate bond
  modified_base (19)..(19): um
  misc_feature (19)..(20): Phosphorothioate bond
  modified_base (20)..(20): cm
gcuccagcaucugcugcuuc

SEQ ID NO: 33 - RNA, 20 nt, Artificial Sequence
  DKLS466380
gcuccagcaucugcugcuuc

SEQ ID NO: 34 - RNA, 22 nt, Artificial Sequence
  DKLS687764
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): am
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): gm
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): gm
  misc_feature (16)..(17): Phosphorothioate bond
  modified_base (17)..(17): cm
  misc_feature (17)..(18): Phosphorothioate bond
  modified_base (18)..(18): um
  misc_feature (18)..(19): Phosphorothioate bond
  modified_base (19)..(19): um
  misc_feature (19)..(20): Phosphorothioate bond
  modified_base (20)..(20): cm
acaucguuaccagacaguguua

SEQ ID NO: 35 - RNA, 22 nt, Artificial Sequence
  DKLS687118
  modified_base (1)..(1): am
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): um
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): um
  misc_feature (7)..(8): Phosphorothioate bond
  modified_base (8)..(8): um
  misc_feature (8)..(9): Phosphorothioate bond
  modified_base (9)..(9): am
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): am
  misc_feature (12)..(13): Phosphorothioate bond
  modified_base (13)..(13): gm
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): am
  misc_feature (16)..(17): Phosphorothioate bond
  modified_base (17)..(17): gm
  misc_feature (17)..(18): Phosphorothioate bond
  modified_base (18)..(18): um
  misc_feature (18)..(19): Phosphorothioate bond
  modified_base (19)..(19): gm
  misc_feature (19)..(20): Phosphorothioate bond
  modified_base (20)..(20): um
  misc_feature (20)..(21): Phosphorothioate bond
  modified_base (21)..(21): um
  misc_feature (21)..(22): Phosphorothioate bond
  modified_base (22)..(22): am
acaugguuccccgacaguguua

SEQ ID NO: 36 - RNA, 20 nt, Artificial Sequence
  DKLS481254
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): cm
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): am
  misc_feature (16)..(17): Phosphorothioate bond
  modified_base (17)..(17): cm
  misc_feature (17)..(18): Phosphorothioate bond
  modified_base (18)..(18): um
  misc_feature (18)..(19): Phosphorothioate bond
  modified_base (19)..(19): gm
  misc_feature (19)..(20): Phosphorothioate bond
  modified_base (20)..(20): gm
aggcaaguccggcucacugg

SEQ ID NO: 37 - RNA, 20 nt, Artificial Sequence
  DKLS727270
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): gm
  misc_feature (17)..(18): Phosphorothioate bond
  modified_base (18)..(18): am
  misc_feature (18)..(19): Phosphorothioate bond
  modified_base (19)..(19): cm
  misc_feature (19)..(20): Phosphorothioate bond
  modified_base (20)..(20): um
cgugucauccgcucucgacu

SEQ ID NO: 38 - RNA, 20 nt, Artificial Sequence
  DKLS748531
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): um
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
ccagacagcuggugucgccu

SEQ ID NO: 39 - RNA, 20 nt, Artificial Sequence
  DKLS357796
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): am
  misc_feature (16)..(17): Phosphorothioate bond
  modified_base (17)..(17): gm
  misc_feature (17)..(18): Phosphorothioate bond
  modified_base (18)..(18): gm
  misc_feature (18)..(19): Phosphorothioate bond
  modified_base (19)..(19): cm
  misc_feature (19)..(20): Phosphorothioate bond
  modified_base (20)..(20): um
ccggugagcgacacuaggcu

SEQ ID NO: 40 - DNA, 20 bp, Artificial Sequence
  DKLS316231
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
ccagugagccggactugccu

SEQ ID NO: 41 - RNA, 20 nt, Artificial Sequence
  DKLS629290
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): um
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
ccagugagcuggacuugccu

SEQ ID NO: 42 - DNA, 20 bp, Artificial Sequence
  DKLS848880
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): am
  misc_feature (4)..(5): Phosphorothioate bond
  modified_base (5)..(5): um
  misc_feature (5)..(6): Phosphorothioate bond
  modified_base (16)..(16): am
  misc_feature (16)..(17): Phosphorothioate bond
  modified_base (17)..(17): cm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): cm
cucautcctaccgacacccc

SEQ ID NO: 43 - RNA, 20 nt, Artificial Sequence
  DKLS644620
  modified_base (1)..(1): cm
  modified_base (2)..(2): cm
  modified_base (3)..(3): am
  modified_base (4)..(4): gm
  modified_base (5)..(5): um
  modified_base (6)..(6): gm
  modified_base (7)..(7): am
  modified_base (8)..(8): gm
  modified_base (9)..(9): cm
  modified_base (10)..(10): cm
  modified_base (11)..(11): gm
  modified_base (12)..(12): gm
  modified_base (13)..(13): am
  modified_base (14)..(14): cm
  modified_base (15)..(15): um
  modified_base (16)..(16): um
  modified_base (17)..(17): gm
  modified_base (18)..(18): cm
  modified_base (19)..(19): cm
  modified_base (20)..(20): um
ccagugagccggacuugccu

SEQ ID NO: 44 - RNA, 20 nt, Artificial Sequence
  DKLS621499
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  modified_base (4)..(4): gm
  modified_base (5)..(5): um
  modified_base (6)..(6): gm
  modified_base (7)..(7): am
  modified_base (8)..(8): gm
  modified_base (9)..(9): cm
  modified_base (10)..(10): cm
  modified_base (11)..(11): gm
  modified_base (12)..(12): gm
  modified_base (13)..(13): am
  modified_base (14)..(14): cm
  modified_base (15)..(15): um
  modified_base (16)..(16): um
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
ccagugagccggacuugccu

SEQ ID NO: 45 - RNA, 20 nt, Artificial Sequence
  DKLS786970
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
cgcgucacucgcacucgccu

SEQ ID NO: 46 - DNA, 20 bp, Artificial Sequence
  DKLS415889
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): um
  modified_base (16)..(16): cm
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
cgcgucactcgcactcgccu

SEQ ID NO: 47 - RNA, 20 nt, Artificial Sequence
  DKLS991101
  misc_feature (1)..(1): ZEN modification
  misc_feature (20)..(20): ZEN modification
ccagugagccggacuugccu

SEQ ID NO: 48 - RNA, 20 nt, Artificial Sequence
  DKLS649218
  misc_feature (1)..(1): ZEN modification
  misc_feature (20)..(20): ZEN modification
cagaggcagcaguacgacgg

SEQ ID NO: 49 - RNA, 20 nt, Artificial Sequence
  DKLS651753
  misc_feature (1)..(1): ZEN modification
  misc_feature (20)..(20): ZEN modification
gugcauggaaucacggagug

SEQ ID NO: 50 - RNA, 20 nt, Artificial Sequence
  DKLS665920
  misc_feature (1)..(1): ZEN modification
  misc_feature (20)..(20): ZEN modification
cacguaccuuagugccucac

SEQ ID NO: 51 - RNA, 20 nt, Artificial Sequence
  DKLS675388
  modified_base (1)..(1): um
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): cm
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): um
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): am
  misc_feature (12)..(13): Phosphorothioate bond
  modified_base (13)..(13): gm
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): um
  misc_feature (18)..(19): Phosphorothioate bond
  modified_base (19)..(19): um
  misc_feature (19)..(20): Phosphorothioate bond
  modified_base (20)..(20): cm
uugacagauuaaguccauuc

SEQ ID NO: 52 - RNA, 20 nt, Artificial Sequence
  DKLS659460
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): cm
  misc_feature (3)..(4): Phosphorothioate bond
  modified_base (4)..(4): am
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): am
  misc_feature (18)..(19): Phosphorothioate bond
  modified_base (19)..(19): gm
  misc_feature (19)..(20): Phosphorothioate bond
  modified_base (20)..(20): am
gccacccgucgguugcuaga

SEQ ID NO: 53 - RNA, 20 nt, Artificial Sequence
  DKLS649547
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): gm
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): am
  misc_feature (12)..(13): Phosphorothioate bond
  modified_base (13)..(13): cm
  misc_feature (13)..(14): Phosphorothioate bond
  modified_base (14)..(14): gm
  misc_feature (14)..(15): Phosphorothioate bond
  modified_base (15)..(15): cm
  misc_feature (15)..(16): Phosphorothioate bond
  modified_base (16)..(16): am
  misc_feature (16)..(17): Phosphorothioate bond
  modified_base (17)..(17): cm
  misc_feature (17)..(18): Phosphorothioate bond
  modified_base (18)..(18): um
  misc_feature (18)..(19): Phosphorothioate bond
  modified_base (19)..(19): gm
  misc_feature (19)..(20): Phosphorothioate bond
  modified_base (20)..(20): am
gcggguccucuacgcacuga

SEQ ID NO: 54 - RNA, 20 nt, Artificial Sequence
  DKLS646683
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): cm
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): um
  misc_feature (8)..(9): Phosphorothioate bond
  modified_base (9)..(9): gm
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): cm
  misc_feature (13)..(14): Phosphorothioate bond
  modified_base (14)..(14): am
  misc_feature (14)..(15): Phosphorothioate bond
  modified_base (15)..(15): um
  misc_feature (15)..(16): Phosphorothioate bond
  modified_base (16)..(16): am
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): am
gcccgucuggcgcauagcua

SEQ ID NO: 55 - RNA, 20 nt, Artificial Sequence
  DKLS679059
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): am
  misc_feature (12)..(13): Phosphorothioate bond
  modified_base (13)..(13): cm
  misc_feature (13)..(14): Phosphorothioate bond
  modified_base (14)..(14): um
  misc_feature (14)..(15): Phosphorothioate bond
  modified_base (15)..(15): um
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): um
gggccucccgcacuugagau

SEQ ID NO: 56 - RNA, 20 nt, Artificial Sequence
  DKLS656105
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): am
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): um
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): gm
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): um
  misc_feature (18)..(19): Phosphorothioate bond
  modified_base (19)..(19): gm
  misc_feature (19)..(20): Phosphorothioate bond
  modified_base (20)..(20): um
ggcacguccgccagucaugu

SEQ ID NO: 57 - RNA, 20 nt, Artificial Sequence
  DKLS420640
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): cm
  misc_feature (6)..(7): Phosphorothioate bond
  modified_base (7)..(7): um
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
ccucucugccgcucuugccu

SEQ ID NO: 58 - RNA, 20 nt, Artificial Sequence
  DKLS374580
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): um
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): cm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
ccugugugccccucuucccu

SEQ ID NO: 59 - RNA, 20 nt, Artificial Sequence
  DKLS463357
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
ccugucagccgcacuugccu

SEQ ID NO: 60 - RNA, 20 nt, Artificial Sequence
  DKLS459520
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): cm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
ccacugagcccgacuucccu

SEQ ID NO: 61 - RNA, 20 nt, Artificial Sequence
  DKLS399970
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): um
ccaguaagccagacuugcau

SEQ ID NO: 62 - RNA, 20 nt, Artificial Sequence
  DKLS459014
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): cm
  misc_feature (17)..(18): Phosphorothioate bond
  modified_base (18)..(18): um
  misc_feature (18)..(19): Phosphorothioate bond
  modified_base (19)..(19): cm
  misc_feature (19)..(20): Phosphorothioate bond
  modified_base (20)..(20): um
ccagugagccgaacuucucu

SEQ ID NO: 63 - RNA, 20 nt, Artificial Sequence
  DKLS447399
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
cuaguaagucggacuugccu

SEQ ID NO: 64 - RNA, 20 nt, Artificial Sequence
  DKLS712428
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): gm
  misc_feature (18)..(19): Phosphorothioate bond
  modified_base (19)..(19): cm
  misc_feature (19)..(20): Phosphorothioate bond
  modified_base (20)..(20): gm
ccagggagccggacuuggcg

SEQ ID NO: 65 - RNA, 20 nt, Artificial Sequence
  DKLS444294
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): um
  misc_feature (18)..(19): Phosphorothioate bond
  modified_base (19)..(19): cm
  misc_feature (19)..(20): Phosphorothioate bond
  modified_base (20)..(20): um
ggagggagucggacuugucu

SEQ ID NO: 66 - RNA, 20 nt, Artificial Sequence
  DKLS438994
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): am
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): gm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): gm
  misc_feature (18)..(19): Phosphorothioate bond
  modified_base (19)..(19): cm
  misc_feature (19)..(20): Phosphorothioate bond
  modified_base (20)..(20): um
gcggugaaccggaguuggcu

SEQ ID NO: 67 - RNA, 19 nt, Artificial Sequence
  DKLS437053
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
ccagugagccggacuugcc

SEQ ID NO: 68 - RNA, 18 nt, Artificial Sequence
  DKLS398126
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): cm
ccagugagccggacuugc

SEQ ID NO: 69 - RNA, 17 nt, Artificial Sequence
  DKLS435532
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
ccagugagccggacuug

SEQ ID NO: 70 - RNA, 16 nt, Artificial Sequence
  DKLS428543
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
ccagugagccggacuu

SEQ ID NO: 71 - RNA, 15 nt, Artificial Sequence
  DKLS426690
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
ccagugagccggacu

SEQ ID NO: 72 - RNA, 14 nt, Artificial Sequence
  DKLS426564
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
ccagugagccggac

SEQ ID NO: 73 - RNA, 13 nt, Artificial Sequence
  DKLS421748
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
ccagugagccgga

SEQ ID NO: 74 - RNA, 12 nt, Artificial Sequence
  DKLS397701
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
ccagugagccgg

SEQ ID NO: 75 - RNA, 11 nt, Artificial Sequence
  DKLS791575
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
ccagugagccg

SEQ ID NO: 76 - RNA, 10 nt, Artificial Sequence
  DKLS378257
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
ccagugagcc

SEQ ID NO: 77-78 - skipped (2 entries)

SEQ ID NO: 79 - RNA, 19 nt, Artificial Sequence
  DKLS503590
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): gm
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): cm
  misc_feature (13)..(14): Phosphorothioate bond
  modified_base (14)..(14): um
  misc_feature (14)..(15): Phosphorothioate bond
  modified_base (15)..(15): um
  misc_feature (15)..(16): Phosphorothioate bond
  modified_base (16)..(16): gm
  misc_feature (16)..(17): Phosphorothioate bond
  modified_base (17)..(17): cm
  misc_feature (17)..(18): Phosphorothioate bond
  modified_base (18)..(18): cm
  misc_feature (18)..(19): Phosphorothioate bond
  modified_base (19)..(19): um
cagugagccggacuugccu

SEQ ID NO: 80 - RNA, 18 nt, Artificial Sequence
  DKLS472247
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): gm
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): cm
  misc_feature (17)..(18): Phosphorothioate bond
  modified_base (18)..(18): um
agugagccggacuugccu

SEQ ID NO: 81 - RNA, 17 nt, Artificial Sequence
  DKLS559250
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): gm
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): ugm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): um
gugagccggacuugccu

SEQ ID NO: 82 - RNA, 16 nt, Artificial Sequence
  DKLS931438
  modified_base (1)..(1): um
  misc_feature (1)..(2): Phosphorothioate bond
  modified_base (2)..(2): gm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): um
  misc_feature (12)..(13): Phosphorothioate bond
  modified_base (13)..(13): gm
  misc_feature (13)..(14): Phosphorothioate bond
  modified_base (14)..(14): cm
  misc_feature (14)..(15): Phosphorothioate bond
  modified_base (15)..(15): cm
  misc_feature (15)..(16): Phosphorothioate bond
  modified_base (16)..(16): um
ugagccggacuugccu

SEQ ID NO: 83 - RNA, 15 nt, Artificial Sequence
  DKLS678949
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): cm
  misc_feature (9)..(10): Phosphorothioate bond
  modified_base (10)..(10): um
  misc_feature (10)..(11): Phosphorothioate bond
  modified_base (11)..(11): um
  misc_feature (11)..(12): Phosphorothioate bond
  modified_base (12)..(12): gm
  misc_feature (12)..(13): Phosphorothioate bond
  modified_base (13)..(13): cm
  misc_feature (13)..(14): Phosphorothioate bond
  modified_base (14)..(14): cm
  misc_feature (14)..(15): Phosphorothioate bond
  modified_base (15)..(15): um
gagccggacuugccu

SEQ ID NO: 84 - RNA, 14 nt, Artificial Sequence
  DKLS479801
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): um
  misc_feature (10)..(11): Phosphorothioate bond
  modified_base (11)..(11): gm
  misc_feature (11)..(12): Phosphorothioate bond
  modified_base (12)..(12): cm
  misc_feature (12)..(13): Phosphorothioate bond
  modified_base (13)..(13): cm
  misc_feature (13)..(14): Phosphorothioate bond
  modified_base (14)..(14): um
agccggacuugccu

SEQ ID NO: 85 - RNA, 13 nt, Artificial Sequence
  DKLS356102
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): gm
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): um
  misc_feature (8)..(9): Phosphorothioate bond
  modified_base (9)..(9): um
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): um
gccggacuugccu

SEQ ID NO: 86 - RNA, 12 nt, Artificial Sequence
  DKLS308827
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): um
  misc_feature (7)..(8): Phosphorothioate bond
  modified_base (8)..(8): um
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): um
ccggacuugccu

SEQ ID NO: 87 - RNA, 11 nt, Artificial Sequence
  DKLS414890
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): cm
  misc_feature (5)..(6): Phosphorothioate bond
  modified_base (6)..(6): um
  misc_feature (6)..(7): Phosphorothioate bond
  modified_base (7)..(7): um
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): um
cggacuugccu

SEQ ID NO: 88 - RNA, 10 nt, Artificial Sequence
  DKLS642581
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): am
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): um
ggacuugccu

SEQ ID NO: 89-90 - skipped (2 entries)

SEQ ID NO: 91 - RNA, 18 nt, Artificial Sequence
  DKLS748531
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): gm
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): cm
  misc_feature (13)..(14): Phosphorothioate bond
  modified_base (14)..(14): um
  misc_feature (14)..(15): Phosphorothioate bond
  modified_base (15)..(15): um
  misc_feature (15)..(16): Phosphorothioate bond
  modified_base (16)..(16): gm
  misc_feature (16)..(17): Phosphorothioate bond
  modified_base (17)..(17): cm
  misc_feature (17)..(18): Phosphorothioate bond
  modified_base (18)..(18): cm
cagugagccggacuugcc

SEQ ID NO: 92 - RNA, 16 nt, Artificial Sequence
  DKLS712428
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): gm
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): gm
  misc_feature (15)..(16): Phosphorothioate bond
  modified_base (16)..(16): cm
agugagccggacuugc

SEQ ID NO: 93 - RNA, 14 nt, Artificial Sequence
  DKLS316231
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): gm
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): um
  misc_feature (13)..(14): Phosphorothioate bond
  modified_base (14)..(14): gm
gugagccggacuug

SEQ ID NO: 94 - RNA, 12 nt, Artificial Sequence
  DKLS399970
  modified_base (1)..(1): um
  misc_feature (1)..(2): Phosphorothioate bond
  modified_base (2)..(2): gm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): um
ugagccggacuu

SEQ ID NO: 95 - RNA, 10 nt, Artificial Sequence
  DKLS308266
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): cm
  misc_feature (9)..(10): Phosphorothioate bond
  modified_base (10)..(10): um
gagccggacu

SEQ ID NO: 96 - skipped

SEQ ID NO: 97 - RNA, 20 nt, Artificial Sequence
  DKLS300878
ccagugagccggacuugccu

SEQ ID NO: 98 - DNA, 20 bp, Artificial Sequence
  DKLS292688
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): gm
  misc_feature (19)..(20): Phosphorothioate bond
  modified_base (20)..(20): gm
cagaggcagcagtacgacgg

SEQ ID NO: 99 - RNA, 20 nt, Artificial Sequence
  DKLS459014
  modified_base (1)..(1): cm
  modified_base (2)..(2): am
  modified_base (3)..(3): gm
  modified_base (4)..(4): am
  modified_base (5)..(5): gm
  modified_base (6)..(6): gm
  modified_base (7)..(7): cm
  modified_base (8)..(8): am
  modified_base (9)..(9): gm
  modified_base (10)..(10): cm
  modified_base (11)..(11): am
  modified_base (12)..(12): gm
  modified_base (13)..(13): um
  modified_base (14)..(14): am
  modified_base (15)..(15): cm
  modified_base (16)..(16): gm
  modified_base (17)..(17): am
  modified_base (18)..(18): cm
  modified_base (19)..(19): gm
  modified_base (20)..(20): gm
cagaggcagcaguacgacgg

SEQ ID NO: 100 - RNA, 20 nt, Artificial Sequence
  DKLS286198
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  modified_base (5)..(5): gm
  modified_base (6)..(6): gm
  modified_base (7)..(7): cm
  modified_base (8)..(8): am
  modified_base (9)..(9): gm
  modified_base (10)..(10): cm
  modified_base (11)..(11): am
  modified_base (12)..(12): gm
  modified_base (13)..(13): um
  modified_base (14)..(14): am
  modified_base (15)..(15): cm
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): gm
  misc_feature (19)..(20): Phosphorothioate bond
  modified_base (20)..(20): gm
cagaggcagcaguacgacgg

SEQ ID NO: 101 - RNA, 20 nt, Artificial Sequence
  DKLS421748
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): um
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): gm
  misc_feature (18)..(19): Phosphorothioate bond
  modified_base (19)..(19): cm
  misc_feature (19)..(20): Phosphorothioate bond
  modified_base (20)..(20): cm
gucuccgucgucaugcugcc

SEQ ID NO: 102 - DNA, 20 bp, Artificial Sequence
  DKLS426564
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): cm
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): gm
  misc_feature (18)..(19): Phosphorothioate bond
  modified_base (19)..(19): cm
  misc_feature (19)..(20): Phosphorothioate bond
  modified_base (20)..(20): cm
gucuccgtcgtcatgcugcc

SEQ ID NO: 103 - RNA, 20 nt, Artificial Sequence
  DKLS426690
  misc_feature (1)..(2): Phosphorothioate bond
  misc_feature (2)..(3): Phosphorothioate bond
  misc_feature (3)..(4): Phosphorothioate bond
  misc_feature (4)..(5): Phosphorothioate bond
  misc_feature (5)..(6): Phosphorothioate bond
  misc_feature (6)..(7): Phosphorothioate bond
  misc_feature (7)..(8): Phosphorothioate bond
  misc_feature (8)..(9): Phosphorothioate bond
  misc_feature (9)..(10): Phosphorothioate bond
  misc_feature (10)..(11): Phosphorothioate bond
  misc_feature (11)..(12): Phosphorothioate bond
  misc_feature (12)..(13): Phosphorothioate bond
  misc_feature (13)..(14): Phosphorothioate bond
  misc_feature (14)..(15): Phosphorothioate bond
  misc_feature (15)..(16): Phosphorothioate bond
  misc_feature (16)..(17): Phosphorothioate bond
  misc_feature (17)..(18): Phosphorothioate bond
  misc_feature (18)..(19): Phosphorothioate bond
  misc_feature (19)..(20): Phosphorothioate bond
ccagugagccggacuugccu

SEQ ID NO: 104 - RNA, 30 nt, Artificial Sequence
  DKLS428543
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): gm
  misc_feature (19)..(20): Phosphorothioate bond
  modified_base (20)..(20): gm
  misc_feature (20)..(21): Phosphorothioate bond
  modified_base (21)..(21): cm
  misc_feature (21)..(22): Phosphorothioate bond
  modified_base (22)..(22): am
  misc_feature (22)..(23): Phosphorothioate bond
  modified_base (23)..(23): gm
  misc_feature (23)..(24): Phosphorothioate bond
  modified_base (24)..(24): am
  misc_feature (24)..(25): Phosphorothioate bond
  modified_base (25)..(25): gm
  misc_feature (25)..(26): Phosphorothioate bond
  modified_base (26)..(26): gm
  misc_feature (26)..(27): Phosphorothioate bond
  modified_base (27)..(27): cm
  misc_feature (27)..(28): Phosphorothioate bond
  modified_base (28)..(28): am
  misc_feature (28)..(29): Phosphorothioate bond
  modified_base (29)..(29): gm
  misc_feature (29)..(30): Phosphorothioate bond
  modified_base (30)..(30): cm
cagaggcagcaguacgacggcagaggcagc

SEQ ID NO: 105 - RNA, 15 nt, Artificial Sequence
  DKLS435532
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
cagaggcagcaguac

SEQ ID NO: 106 - DNA, 10 bp, Artificial Sequence
  DKLS398126
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
cagaggcagc

SEQ ID NO: 107 - DNA, 20 bp, Artificial Sequence
  DKLS437053
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): am
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (17)..(17): cm
  misc_feature (17)..(18): Phosphorothioate bond
  modified_base (18)..(18): am
  misc_feature (18)..(19): Phosphorothioate bond
  modified_base (19)..(19): cm
  misc_feature (19)..(20): Phosphorothioate bond
  modified_base (20)..(20): am
ggagccggacaagggtcaca

SEQ ID NO: 108 - DNA, 20 bp, Artificial Sequence
  DKLS394649
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): am
  misc_feature (9)..(10): Phosphorothioate bond
  modified_base (10)..(10): gm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): gm
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): gm
  misc_feature (19)..(20): Phosphorothioate bond
  modified_base (20)..(20): am
gggacccaaggagcgtacga

SEQ ID NO: 109 - DNA, 19 bp, Artificial Sequence
  DKLS891943
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): am
  misc_feature (14)..(15): Phosphorothioate bond
  modified_base (15)..(15): gm
  misc_feature (15)..(16): Phosphorothioate bond
  modified_base (16)..(16): am
  misc_feature (16)..(17): Phosphorothioate bond
  modified_base (17)..(17): cm
  misc_feature (17)..(18): Phosphorothioate bond
  modified_base (18)..(18): cm
  misc_feature (18)..(19): Phosphorothioate bond
  modified_base (19)..(19): am
gagcgagacgcggagacca

SEQ ID NO: 110 - DNA, 19 bp, Artificial Sequence
  DKLS894584
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): gm
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): am
  misc_feature (14)..(15): Phosphorothioate bond
  modified_base (15)..(15): am
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): cm
gcggaacggacggaagacc

SEQ ID NO: 111 - DNA, 20 bp, Artificial Sequence
  DKLS629290
  modified_base (1)..(1): gm
  misc_feature (1)..(2): Phosphorothioate bond
  modified_base (2)..(2): cm
  misc_feature (2)..(3): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): cm
  misc_feature (14)..(15): Phosphorothioate bond
  modified_base (15)..(15): am
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): am
gctgacggcacggcagagaa

SEQ ID NO: 112 - RNA, 20 nt, Artificial Sequence
  DKLS621499
  modified_base (1)..(1): um
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): am
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): gm
uggaggcagcaguacaacug

SEQ ID NO: 113 - RNA, 20 nt, Artificial Sequence
  DKLS765774
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): gm
gggcggcaguaguccgacag

SEQ ID NO: 114 - RNA, 20 nt, Artificial Sequence
  DKLS656574
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): um
  misc_feature (18)..(19): Phosphorothioate bond
  modified_base (19)..(19): gm
  misc_feature (19)..(20): Phosphorothioate bond
  modified_base (20)..(20): gm
gagaagaagcaguacgaugg

SEQ ID NO: 115 - RNA, 20 nt, Artificial Sequence
  DKLS859346
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): um
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): um
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): gm
cauagucaccuguacuaccg

SEQ ID NO: 116 - RNA, 20 nt, Artificial Sequence
  DKLS812894
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): gm
  misc_feature (19)..(20): Phosphorothioate bond
  modified_base (20)..(20): gm
caccgucaucacuaccacgg

SEQ ID NO: 117 - RNA, 20 nt, Artificial Sequence
  DKLS817119
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): um
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): um
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): cm
  misc_feature (17)..(18): Phosphorothioate bond
  modified_base (18)..(18): cm
  misc_feature (18)..(19): Phosphorothioate bond
  modified_base (19)..(19): gm
  misc_feature (19)..(20): Phosphorothioate bond
  modified_base (20)..(20): gm
cacucgcugcauuucgccgg

SEQ ID NO: 118 - RNA, 20 nt, Artificial Sequence
  DKLS333877
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): gm
  misc_feature (19)..(20): Phosphorothioate bond
  modified_base (20)..(20): gm
cugugccaucuguaccacgg

SEQ ID NO: 119 - RNA, 19 nt, Artificial Sequence
  DKLS357796
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): gm
cagaggcagcaguacgacg

SEQ ID NO: 120 - RNA, 18 nt, Artificial Sequence
  DKLS420640
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): cm
cagaggcagcaguacgac

SEQ ID NO: 121 - RNA, 17 nt, Artificial Sequence
  DKLS463357
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): am
cagaggcagcaguacga

SEQ ID NO: 122 - RNA, 16 nt, Artificial Sequence
  DKLS374580
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): gm
cagaggcagcaguacg

SEQ ID NO: 123 - RNA, 15 nt, Artificial Sequence
  DKLS840764
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
cagaggcagcaguac

SEQ ID NO: 124 - RNA, 14 nt, Artificial Sequence
  DKLS860782
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
cagaggcagcagua

SEQ ID NO: 125 - RNA, 13 nt, Artificial Sequence
  DKLS834767
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
cagaggcagcagu

SEQ ID NO: 126 - DNA, 12 bp, Artificial Sequence
  DKLS805605
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): gm
cagaggcagcag

SEQ ID NO: 127 - DNA, 11 bp, Artificial Sequence
  DKLS415889
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
cagaggcagca

SEQ ID NO: 128 - DNA, 10 bp, Artificial Sequence
  DKLS786970
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
cagaggcagc

SEQ ID NO: 129-130 - skipped (2 entries)

SEQ ID NO: 131 - RNA, 19 nt, Artificial Sequence
  DKLS334259
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): am
  misc_feature (10)..(11): Phosphorothioate bond
  modified_base (11)..(11): gm
  misc_feature (11)..(12): Phosphorothioate bond
  modified_base (12)..(12): um
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): am
  misc_feature (16)..(17): Phosphorothioate bond
  modified_base (17)..(17): cm
  misc_feature (17)..(18): Phosphorothioate bond
  modified_base (18)..(18): gm
  misc_feature (18)..(19): Phosphorothioate bond
  modified_base (19)..(19): gm
agaggcagcaguacgacgg

SEQ ID NO: 132 - RNA, 18 nt, Artificial Sequence
  DKLS958923
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): am
  misc_feature (9)..(10): Phosphorothioate bond
  modified_base (10)..(10): gm
  misc_feature (10)..(11): Phosphorothioate bond
  modified_base (11)..(11): um
  misc_feature (11)..(12): Phosphorothioate bond
  modified_base (12)..(12): am
  misc_feature (12)..(13): Phosphorothioate bond
  modified_base (13)..(13): cm
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): cm
  misc_feature (16)..(17): Phosphorothioate bond
  modified_base (17)..(17): gm
  misc_feature (17)..(18): Phosphorothioate bond
  modified_base (18)..(18): gm
gaggcagcaguacgacgg

SEQ ID NO: 133 - RNA, 17 nt, Artificial Sequence
  DKLS889313
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): gm
aggcagcaguacgacgg

SEQ ID NO: 134 - RNA, 16 nt, Artificial Sequence
  DKLS717876
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): um
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): gm
ggcagcaguacgacgg

SEQ ID NO: 135 - RNA, 15 nt, Artificial Sequence
  DKLS757016
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): am
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): cm
  misc_feature (13)..(14): Phosphorothioate bond
  modified_base (14)..(14): gm
  misc_feature (14)..(15): Phosphorothioate bond
  modified_base (15)..(15): gm
gcagcaguacgacgg

SEQ ID NO: 136 - RNA, 14 nt, Artificial Sequence
  DKLS734654
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): um
  misc_feature (7)..(8): Phosphorothioate bond
  modified_base (8)..(8): am
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): gm
cagcaguacgacgg

SEQ ID NO: 137 - RNA, 13 nt, Artificial Sequence
  DKLS762544
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): um
  misc_feature (6)..(7): Phosphorothioate bond
  modified_base (7)..(7): am
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): gm
agcaguacgacgg

SEQ ID NO: 138 - RNA, 12 nt, Artificial Sequence
  DKLS727270
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
gcaguacgacgg

SEQ ID NO: 139 - RNA, 11 nt, Artificial Sequence
  DKLS947541
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): gm
caguacgacgg

SEQ ID NO: 140 - RNA, 10 nt, Artificial Sequence
  DKLS447399
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): am
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): gm
aguacgacgg

SEQ ID NO: 141-142 - skipped (2 entries)

SEQ ID NO: 143 - RNA, 18 nt, Artificial Sequence
  DKLS868095
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): am
  misc_feature (10)..(11): Phosphorothioate bond
  modified_base (11)..(11): gum
  misc_feature (11)..(12): Phosphorothioate bond
  modified_base (12)..(12): um
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): am
  misc_feature (16)..(17): Phosphorothioate bond
  modified_base (17)..(17): cm
  misc_feature (17)..(18): Phosphorothioate bond
  modified_base (18)..(18): gm
agaggcagcaguacgacg

SEQ ID NO: 144 - RNA, 16 nt, Artificial Sequence
  DKLS776802
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): am
  misc_feature (9)..(10): Phosphorothioate bond
  modified_base (10)..(10): gm
  misc_feature (10)..(11): Phosphorothioate bond
  modified_base (11)..(11): um
  misc_feature (11)..(12): Phosphorothioate bond
  modified_base (12)..(12): am
  misc_feature (12)..(13): Phosphorothioate bond
  modified_base (13)..(13): cm
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): cm
gaggcagcaguacgac

SEQ ID NO: 145 - RNA, 14 nt, Artificial Sequence
  DKLS873408
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): am
aggcagcaguacga

SEQ ID NO: 146 - RNA, 12 nt, Artificial Sequence
  DKLS929958
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): um
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): gm
ggcagcaguacg

SEQ ID NO: 147 - RNA, 10 nt, Artificial Sequence
  DKLS870416
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): am
  misc_feature (9)..(10): Phosphorothioate bond
  modified_base (10)..(10): cm
gcagcaguac

SEQ ID NO: 148 - skipped

SEQ ID NO: 149 - RNA, 20 nt, Artificial Sequence
  DKLS858330
cagaggcagcaguacgacgg

SEQ ID NO: 150 - DNA, 20 bp, Artificial Sequence
  DKLS184327
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): gm
gugcatggaatcacggagug

SEQ ID NO: 151 - RNA, 20 nt, Artificial Sequence
  DKLS934835
  modified_base (1)..(1): gm
  modified_base (2)..(2): um
  modified_base (3)..(3): gm
  modified_base (4)..(4): cm
  modified_base (5)..(5): am
  modified_base (6)..(6): um
  modified_base (7)..(7): gm
  modified_base (8)..(8): gm
  modified_base (9)..(9): am
  modified_base (10)..(10): am
  modified_base (11)..(11): um
  modified_base (12)..(12): cm
  modified_base (13)..(13): am
  modified_base (14)..(14): cm
  modified_base (15)..(15): gm
  modified_base (16)..(16): gm
  modified_base (17)..(17): am
  modified_base (18)..(18): gm
  modified_base (19)..(19): um
  modified_base (20)..(20): gm
gugcauggaaucacggagug

SEQ ID NO: 152 - RNA, 20 nt, Artificial Sequence
  DKLS945812
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  modified_base (5)..(5): am
  modified_base (6)..(6): um
  modified_base (7)..(7): gm
  modified_base (8)..(8): gm
  modified_base (9)..(9): am
  modified_base (10)..(10): am
  modified_base (11)..(11): um
  modified_base (12)..(12): cm
  modified_base (13)..(13): am
  modified_base (14)..(14): cm
  modified_base (15)..(15): gm
  modified_base (16)..(16): gm
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): gm
gugcauggaaucacggagug

SEQ ID NO: 153 - RNA, 20 nt, Artificial Sequence
  DKLS577569
  misc_feature (1)..(2): Phosphorothioate bond
  misc_feature (2)..(3): Phosphorothioate bond
  misc_feature (3)..(4): Phosphorothioate bond
  misc_feature (4)..(5): Phosphorothioate bond
  misc_feature (5)..(6): Phosphorothioate bond
  misc_feature (6)..(7): Phosphorothioate bond
  misc_feature (7)..(8): Phosphorothioate bond
  misc_feature (8)..(9): Phosphorothioate bond
  misc_feature (9)..(10): Phosphorothioate bond
  misc_feature (10)..(11): Phosphorothioate bond
  misc_feature (11)..(12): Phosphorothioate bond
  misc_feature (12)..(13): Phosphorothioate bond
  misc_feature (13)..(14): Phosphorothioate bond
  misc_feature (14)..(15): Phosphorothioate bond
  misc_feature (15)..(16): Phosphorothioate bond
  misc_feature (16)..(17): Phosphorothioate bond
  misc_feature (17)..(18): Phosphorothioate bond
  misc_feature (18)..(19): Phosphorothioate bond
  misc_feature (19)..(20): Phosphorothioate bond
cagaggcagcaguacgacgg

SEQ ID NO: 154 - RNA, 30 nt, Artificial Sequence
  DKLS722361
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): gm
  misc_feature (20)..(21): Phosphorothioate bond
  modified_base (21)..(21): gm
  misc_feature (21)..(22): Phosphorothioate bond
  modified_base (22)..(22): um
  misc_feature (22)..(23): Phosphorothioate bond
  modified_base (23)..(23): gm
  misc_feature (23)..(24): Phosphorothioate bond
  modified_base (24)..(24): cm
  misc_feature (24)..(25): Phosphorothioate bond
  modified_base (25)..(25): am
  misc_feature (25)..(26): Phosphorothioate bond
  modified_base (26)..(26): um
  misc_feature (26)..(27): Phosphorothioate bond
  modified_base (27)..(27): gm
  misc_feature (27)..(28): Phosphorothioate bond
  modified_base (28)..(28): gm
  misc_feature (28)..(29): Phosphorothioate bond
  modified_base (29)..(29): am
  misc_feature (29)..(30): Phosphorothioate bond
  modified_base (30)..(30): am
gugcauggaaucacggaguggugcauggaa

SEQ ID NO: 155 - RNA, 20 nt, Artificial Sequence
  DKLS721579
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): um
  misc_feature (9)..(10): Phosphorothioate bond
  modified_base (10)..(10): gm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): cm
  misc_feature (13)..(14): Phosphorothioate bond
  modified_base (14)..(14): gm
  misc_feature (14)..(15): Phosphorothioate bond
  modified_base (15)..(15): um
  misc_feature (15)..(16): Phosphorothioate bond
  modified_base (16)..(16): am
  misc_feature (16)..(17): Phosphorothioate bond
  modified_base (17)..(17): gm
  misc_feature (17)..(18): Phosphorothioate bond
  modified_base (18)..(18): am
  misc_feature (18)..(19): Phosphorothioate bond
  modified_base (19)..(19): um
  misc_feature (19)..(20): Phosphorothioate bond
  modified_base (20)..(20): am
gaguccggugagcguagaua

SEQ ID NO: 156 - RNA, 20 nt, Artificial Sequence
  DKLS746864
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): um
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): am
  misc_feature (14)..(15): Phosphorothioate bond
  modified_base (15)..(15): gm
  misc_feature (15)..(16): Phosphorothioate bond
  modified_base (16)..(16): am
  misc_feature (16)..(17): Phosphorothioate bond
  modified_base (17)..(17): gm
  misc_feature (17)..(18): Phosphorothioate bond
  modified_base (18)..(18): um
  misc_feature (18)..(19): Phosphorothioate bond
  modified_base (19)..(19): gm
  misc_feature (19)..(20): Phosphorothioate bond
  modified_base (20)..(20): um
gcauagacgucggagagugu

SEQ ID NO: 157 - RNA, 20 nt, Artificial Sequence
  DKLS744278
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): um
  misc_feature (15)..(16): Phosphorothioate bond
  modified_base (16)..(16): am
  misc_feature (16)..(17): Phosphorothioate bond
  modified_base (17)..(17): cm
  misc_feature (17)..(18): Phosphorothioate bond
  modified_base (18)..(18): am
  misc_feature (18)..(19): Phosphorothioate bond
  modified_base (19)..(19): am
  misc_feature (19)..(20): Phosphorothioate bond
  modified_base (20)..(20): um
gguaggacgcuggguacaau

SEQ ID NO: 158 - RNA, 20 nt, Artificial Sequence
  DKLS421479
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): um
  misc_feature (14)..(15): Phosphorothioate bond
  modified_base (15)..(15): am
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): um
guagcaggcucgguagagau

SEQ ID NO: 159 - RNA, 20 nt, Artificial Sequence
  DKLS958321
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): gm
gugcauggaaucacggagug

SEQ ID NO: 160 - RNA, 20 nt, Artificial Sequence
  DKLS710955
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): am
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): um
  misc_feature (18)..(19): Phosphorothioate bond
  modified_base (19)..(19): am
  misc_feature (19)..(20): Phosphorothioate bond
  modified_base (20)..(20): um
gguaggacgcggacaguuau

SEQ ID NO: 161 - RNA, 20 nt, Artificial Sequence
  DKLS701719
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): am
  misc_feature (18)..(19): Phosphorothioate bond
  modified_base (19)..(19): um
  misc_feature (19)..(20): Phosphorothioate bond
  modified_base (20)..(20): gm
gugcauggaaacacgguaug

SEQ ID NO: 162 - RNA, 20 nt, Artificial Sequence
  DKLS653496
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): gm
cagcauagaaucacggagug

SEQ ID NO: 163 - RNA, 20 nt, Artificial Sequence
  DKLS377200
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): um
  misc_feature (9)..(10): Phosphorothioate bond
  modified_base (10)..(10): gm
  misc_feature (10)..(11): Phosphorothioate bond
  modified_base (11)..(11): um
  misc_feature (11)..(12): Phosphorothioate bond
  modified_base (12)..(12): um
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): gm
  misc_feature (19)..(20): Phosphorothioate bond
  modified_base (20)..(20): gm
gugcagaguguuacggaggg

SEQ ID NO: 164 - RNA, 20 nt, Artificial Sequence
  DKLS644620
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): am
  misc_feature (18)..(19): Phosphorothioate bond
  modified_base (19)..(19): gm
  misc_feature (19)..(20): Phosphorothioate bond
  modified_base (20)..(20): gm
gugcagagaaucacugaagg

SEQ ID NO: 165 - RNA, 20 nt, Artificial Sequence
  DKLS683540
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): um
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): am
  misc_feature (18)..(19): Phosphorothioate bond
  modified_base (19)..(19): um
  misc_feature (19)..(20): Phosphorothioate bond
  modified_base (20)..(20): gm
guccaugucuucucggaaug

SEQ ID NO: 166 - RNA, 20 nt, Artificial Sequence
  DKLS968463
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): um
  misc_feature (6)..(7): Phosphorothioate bond
  modified_base (7)..(7): um
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): um
cugcuuugaaucacgcaguu

SEQ ID NO: 167 - RNA, 20 nt, Artificial Sequence
  DKLS753270
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): um
  misc_feature (16)..(17): Phosphorothioate bond
  modified_base (17)..(17): um
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): gm
guccuugucaucacguugug

SEQ ID NO: 168 - RNA, 19 nt, Artificial Sequence
  DKLS754387
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): um
gugcauggaaucacggagu

SEQ ID NO: 169 - RNA, 18 nt, Artificial Sequence
  DKLS628743
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
gugcauggaaucacggag

SEQ ID NO: 170 - RNA, 17 nt, Artificial Sequence
  DKLS812155
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): am
gugcauggaaucacgga

SEQ ID NO: 171 - RNA, 16 nt, Artificial Sequence
  DKLS820015
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): gm
gugcauggaaucacgg

SEQ ID NO: 172 - RNA, 15 nt, Artificial Sequence
  DKLS672961
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
gugcauggaaucacg

SEQ ID NO: 173 - RNA, 14 nt, Artificial Sequence
  DKLS882074
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
gugcauggaaucac

SEQ ID NO: 174 - RNA, 13 nt, Artificial Sequence
  DKLS342515
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
gugcauggaauca

SEQ ID NO: 175 - RNA, 12 nt, Artificial Sequence
  DKLS970986
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
gugcauggaauc

SEQ ID NO: 176 - RNA, 11 nt, Artificial Sequence
  DKLS414293
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
gugcauggaau

SEQ ID NO: 177 - RNA, 10 nt, Artificial Sequence
  DKLS369957
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
gugcauggaa

SEQ ID NO: 178-179 - skipped (2 entries)

SEQ ID NO: 180 - RNA, 19 nt, Artificial Sequence
  DKLS403667
  modified_base (1)..(1): um
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): am
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): am
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): am
  misc_feature (12)..(13): Phosphorothioate bond
  modified_base (13)..(13): cm
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (16)..(16): am
  misc_feature (16)..(17): Phosphorothioate bond
  modified_base (17)..(17): gm
  misc_feature (17)..(18): Phosphorothioate bond
  modified_base (18)..(18): um
  misc_feature (18)..(19): Phosphorothioate bond
  modified_base (19)..(19): gm
ugcauggaaucacggagug

SEQ ID NO: 181 - RNA, 18 nt, Artificial Sequence
  DKLS474224
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): um
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): am
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): gm
gcauggaaucacggagug

SEQ ID NO: 182 - RNA, 17 nt, Artificial Sequence
  DKLS959154
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): gm
  misc_feature (5)..(6): Phosphorothioate bond
  modified_base (6)..(6): am
  misc_feature (6)..(7): Phosphorothioate bond
  modified_base (7)..(7): am
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): am
  misc_feature (14)..(15): Phosphorothioate bond
  modified_base (15)..(15): gm
  misc_feature (15)..(16): Phosphorothioate bond
  modified_base (16)..(16): um
  misc_feature (16)..(17): Phosphorothioate bond
  modified_base (17)..(17): gm
cauggaaucacggagug

SEQ ID NO: 183 - RNA, 16 nt, Artificial Sequence
  DKLS485681
  modified_base (1)..(1): am
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): um
  misc_feature (7)..(8): Phosphorothioate bond
  modified_base (8)..(8): cm
  misc_feature (8)..(9): Phosphorothioate bond
  modified_base (9)..(9): am
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): gm
  misc_feature (14)..(15): Phosphorothioate bond
  modified_base (15)..(15): um
  misc_feature (15)..(16): Phosphorothioate bond
  modified_base (16)..(16): gm
auggaaucacggagug

SEQ ID NO: 184 - RNA, 15 nt, Artificial Sequence
  DKLS463625
  modified_base (1)..(1): um
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): gm
  misc_feature (13)..(14): Phosphorothioate bond
  modified_base (14)..(14): um
  misc_feature (14)..(15): Phosphorothioate bond
  modified_base (15)..(15): gm
uggaaucacggagug

SEQ ID NO: 185 - RNA, 14 nt, Artificial Sequence
  DKLS799151
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): am
  misc_feature (3)..(4): Phosphorothioate bond
  modified_base (4)..(4): am
  misc_feature (4)..(5): Phosphorothioate bond
  modified_base (5)..(5): um
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): gm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): gm
ggaaucacggagug

SEQ ID NO: 186 - RNA, 13 nt, Artificial Sequence
  DKLS965031
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): am
  misc_feature (3)..(4): Phosphorothioate bond
  modified_base (4)..(4): um
  misc_feature (4)..(5): Phosphorothioate bond
  modified_base (5)..(5): cm
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): gm
  misc_feature (9)..(10): Phosphorothioate bond
  modified_base (10)..(10): am
  misc_feature (10)..(11): Phosphorothioate bond
  modified_base (11)..(11): gm
  misc_feature (11)..(12): Phosphorothioate bond
  modified_base (12)..(12): um
  misc_feature (12)..(13): Phosphorothioate bond
  modified_base (13)..(13): gm
gaaucacggagug

SEQ ID NO: 187 - RNA, 12 nt, Artificial Sequence
  DKLS530510
  modified_base (1)..(1): am
  misc_feature (1)..(2): Phosphorothioate bond
  modified_base (2)..(2): am
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): gm
  misc_feature (10)..(11): Phosphorothioate bond
  modified_base (11)..(11): um
  misc_feature (11)..(12): Phosphorothioate bond
  modified_base (12)..(12): gm
aaucacggagug

SEQ ID NO: 188 - RNA, 11 nt, Artificial Sequence
  DKLS881554
  modified_base (1)..(1): am
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): am
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): um
  misc_feature (10)..(11): Phosphorothioate bond
  modified_base (11)..(11): gm
aucacggagug

SEQ ID NO: 189 - RNA, 10 nt, Artificial Sequence
  DKLS909932
  modified_base (1)..(1): um
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): um
  misc_feature (9)..(10): Phosphorothioate bond
  modified_base (10)..(10): gm
ucacggagug

SEQ ID NO: 190 - RNA, 18 nt, Artificial Sequence
  DKLS835077
  modified_base (1)..(1): um
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): am
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): am
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): am
  misc_feature (12)..(13): Phosphorothioate bond
  modified_base (13)..(13): cm
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (16)..(16): am
  misc_feature (16)..(17): Phosphorothioate bond
  modified_base (17)..(17): gm
  misc_feature (17)..(18): Phosphorothioate bond
  modified_base (18)..(18): um
ugcauggaaucacggagu

SEQ ID NO: 191 - RNA, 16 nt, Artificial Sequence
  DKLS670217
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): um
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): am
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): gm
gcauggaaucacggag

SEQ ID NO: 192 - RNA, 14 nt, Artificial Sequence
  DKLS502504
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): gm
  misc_feature (5)..(6): Phosphorothioate bond
  modified_base (6)..(6): am
  misc_feature (6)..(7): Phosphorothioate bond
  modified_base (7)..(7): am
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): am
cauggaaucacgga

SEQ ID NO: 193 - RNA, 12 nt, Artificial Sequence
  DKLS472198
  modified_base (1)..(1): am
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): um
  misc_feature (7)..(8): Phosphorothioate bond
  modified_base (8)..(8): cm
  misc_feature (8)..(9): Phosphorothioate bond
  modified_base (9)..(9): am
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
auggaaucacgg

SEQ ID NO: 194 - RNA, 10 nt, Artificial Sequence
  DKLS475358
  modified_base (1)..(1): um
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): am
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): cm
  misc_feature (9)..(10): Phosphorothioate bond
  modified_base (10)..(10): gm
uggaaucacg

SEQ ID NO: 195 - skipped

SEQ ID NO: 196 - RNA, 30 nt, Artificial Sequence
  DKLS636275
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): cm
  misc_feature (20)..(21): Phosphorothioate bond
  modified_base (21)..(21): cm
  misc_feature (21)..(22): Phosphorothioate bond
  modified_base (22)..(22): am
  misc_feature (22)..(23): Phosphorothioate bond
  modified_base (23)..(23): cm
  misc_feature (23)..(24): Phosphorothioate bond
  modified_base (24)..(24): gm
  misc_feature (24)..(25): Phosphorothioate bond
  modified_base (25)..(25): um
  misc_feature (25)..(26): Phosphorothioate bond
  modified_base (26)..(26): am
  misc_feature (26)..(27): Phosphorothioate bond
  modified_base (27)..(27): cm
  misc_feature (27)..(28): Phosphorothioate bond
  modified_base (28)..(28): cm
  misc_feature (28)..(29): Phosphorothioate bond
  modified_base (29)..(29): um
  misc_feature (29)..(30): Phosphorothioate bond
  modified_base (30)..(30): um
cacguaccuuagugccucaccacguaccuu

SEQ ID NO: 197 - skipped

SEQ ID NO: 198 - RNA, 20 nt, Artificial Sequence
  DKLS659460
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): cm
cacguaccuuagugccucac

SEQ ID NO: 199 - DNA, 20 bp, Artificial Sequence
  DKLS646683
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): cm
cacguaccttagtgccucac

SEQ ID NO: 200 - RNA, 20 nt, Artificial Sequence
  DKLS966527
  modified_base (1)..(1): cm
  modified_base (2)..(2): am
  modified_base (3)..(3): cm
  modified_base (4)..(4): gm
  modified_base (5)..(5): um
  modified_base (6)..(6): am
  modified_base (7)..(7): cm
  modified_base (8)..(8): cm
  modified_base (9)..(9): um
  modified_base (10)..(10): um
  modified_base (11)..(11): am
  modified_base (12)..(12): gm
  modified_base (13)..(13): um
  modified_base (14)..(14): gm
  modified_base (15)..(15): cm
  modified_base (16)..(16): cm
  modified_base (17)..(17): um
  modified_base (18)..(18): cm
  modified_base (19)..(19): am
  modified_base (20)..(20): cm
cacguaccuuagugccucac

SEQ ID NO: 201 - RNA, 20 nt, Artificial Sequence
  DKLS333772
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): gm
  modified_base (5)..(5): um
  modified_base (6)..(6): am
  modified_base (7)..(7): cm
  modified_base (8)..(8): cm
  modified_base (9)..(9): um
  modified_base (10)..(10): um
  modified_base (11)..(11): am
  modified_base (12)..(12): gm
  modified_base (13)..(13): um
  modified_base (14)..(14): gm
  modified_base (15)..(15): cm
  modified_base (16)..(16): cm
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): cm
cacguaccuuagugccucac

SEQ ID NO: 202 - skipped

SEQ ID NO: 203 - RNA, 20 nt, Artificial Sequence
  DKLS669778
  misc_feature (1)..(2): Phosphorothioate bond
  misc_feature (2)..(3): Phosphorothioate bond
  misc_feature (3)..(4): Phosphorothioate bond
  misc_feature (4)..(5): Phosphorothioate bond
  misc_feature (5)..(6): Phosphorothioate bond
  misc_feature (6)..(7): Phosphorothioate bond
  misc_feature (7)..(8): Phosphorothioate bond
  misc_feature (8)..(9): Phosphorothioate bond
  misc_feature (9)..(10): Phosphorothioate bond
  misc_feature (10)..(11): Phosphorothioate bond
  misc_feature (11)..(12): Phosphorothioate bond
  misc_feature (12)..(13): Phosphorothioate bond
  misc_feature (13)..(14): Phosphorothioate bond
  misc_feature (14)..(15): Phosphorothioate bond
  misc_feature (15)..(16): Phosphorothioate bond
  misc_feature (16)..(17): Phosphorothioate bond
  misc_feature (17)..(18): Phosphorothioate bond
  misc_feature (18)..(19): Phosphorothioate bond
  misc_feature (19)..(20): Phosphorothioate bond
gugcauggaaucacggagug

SEQ ID NO: 204 - RNA, 15 nt, Artificial Sequence
  DKLS404613
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): cm
cacguaccuuagugc

SEQ ID NO: 205 - RNA, 10 nt, Artificial Sequence
  DKLS649547
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): um
cacguaccuu

SEQ ID NO: 206 - RNA, 20 nt, Artificial Sequence
  DKLS438994
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): um
  misc_feature (6)..(7): Phosphorothioate bond
  modified_base (7)..(7): am
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): um
  misc_feature (11)..(12): Phosphorothioate bond
  modified_base (12)..(12): um
  misc_feature (12)..(13): Phosphorothioate bond
  modified_base (13)..(13): cm
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): am
  misc_feature (18)..(19): Phosphorothioate bond
  modified_base (19)..(19): cm
  misc_feature (19)..(20): Phosphorothioate bond
  modified_base (20)..(20): am
gcgcuuaccguuccucaaca

SEQ ID NO: 207 - RNA, 20 nt, Artificial Sequence
  DKLS491049
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): cm
  misc_feature (13)..(14): Phosphorothioate bond
  modified_base (14)..(14): cm
  misc_feature (14)..(15): Phosphorothioate bond
  modified_base (15)..(15): am
  misc_feature (15)..(16): Phosphorothioate bond
  modified_base (16)..(16): am
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): am
gcacgucucgcuccaaucua

SEQ ID NO: 208 - RNA, 20 nt, Artificial Sequence
  DKLS466380
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): cm
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): cm
gacguaccuuaguaccccac

SEQ ID NO: 209 - RNA, 20 nt, Artificial Sequence
  DKLS404663
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): uam
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): gm
  misc_feature (14)..(15): Phosphorothioate bond
  modified_base (15)..(15): cm
  misc_feature (15)..(16): Phosphorothioate bond
  modified_base (16)..(16): um
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): cm
cacguaccuuagagcuuccc

SEQ ID NO: 210 - RNA, 20 nt, Artificial Sequence
  DKLS645944
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): um
  misc_feature (9)..(10): Phosphorothioate bond
  modified_base (10)..(10): am
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): cm
caggaacguaagugggucac

SEQ ID NO: 211 - RNA, 20 nt, Artificial Sequence
  DKLS627907
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): am
  misc_feature (9)..(10): Phosphorothioate bond
  modified_base (10)..(10): gm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): cm
cacguagcagagugggacac

SEQ ID NO: 212 - RNA, 20 nt, Artificial Sequence
  DKLS341370
  modified_base (1)..(1): cm
  modified_base (2)..(2): um
  modified_base (3)..(3): cm
  modified_base (4)..(4): am
  modified_base (5)..(5): um
  modified_base (6)..(6): um
  modified_base (7)..(7): cm
  modified_base (8)..(8): cm
  modified_base (9)..(9): um
  modified_base (10)..(10): am
  modified_base (11)..(11): cm
  modified_base (12)..(12): cm
  modified_base (13)..(13): gm
  modified_base (14)..(14): am
  modified_base (15)..(15): cm
  modified_base (16)..(16): am
  modified_base (17)..(17): cm
  modified_base (18)..(18): cm
  modified_base (19)..(19): cm
  modified_base (20)..(20): cm
cucauuccuaccgacacccc

SEQ ID NO: 213 - DNA, 20 bp, Artificial Sequence
  DKLS776792
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): gm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): am
  misc_feature (14)..(15): Phosphorothioate bond
  modified_base (15)..(15): am
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): gm
aggaagagagggaaagagag

SEQ ID NO: 214 - DNA, 20 bp, Artificial Sequence
  DKLS402835
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): am
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): gm
  misc_feature (16)..(17): Phosphorothioate bond
  modified_base (17)..(17): gm
  misc_feature (17)..(18): Phosphorothioate bond
  modified_base (18)..(18): am
  misc_feature (18)..(19): Phosphorothioate bond
  modified_base (19)..(19): gm
  misc_feature (19)..(20): Phosphorothioate bond
  modified_base (20)..(20): am
agggagagaagaagaggaga

SEQ ID NO: 215 - DNA, 15 bp, Artificial Sequence
  DKLS444294
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): gm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): am
  misc_feature (14)..(15): Phosphorothioate bond
  modified_base (15)..(15): am
aggaagagagggaaa

SEQ ID NO: 216 - DNA, 15 bp, Artificial Sequence
  DKLS656105
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): am
  misc_feature (13)..(14): Phosphorothioate bond
  modified_base (14)..(14): gm
  misc_feature (14)..(15): Phosphorothioate bond
  modified_base (15)..(15): am
agggagagaagaaga

SEQ ID NO: 217 - DNA, 10 bp, Artificial Sequence
  DKLS492769
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): gm
aggaagagag

SEQ ID NO: 218 - RNA, 20 nt, Artificial Sequence
  DKLS466440
gugcauggaaucacggagug

SEQ ID NO: 219 - RNA, 20 nt, Artificial Sequence
  DKLS693540
  modified_base (1)..(1): um
  misc_feature (1)..(2): Phosphorothioate bond
  modified_base (2)..(2): cm
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): um
  misc_feature (5)..(6): Phosphorothioate bond
  modified_base (6)..(6): cm
  misc_feature (6)..(7): Phosphorothioate bond
  modified_base (7)..(7): um
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): cm
uccuucucucccuuucucuc

SEQ ID NO: 220 - RNA, 20 nt, Artificial Sequence
  DKLS403215
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): um
  misc_feature (3)..(4): Phosphorothioate bond
  modified_base (4)..(4): um
  misc_feature (4)..(5): Phosphorothioate bond
  modified_base (5)..(5): cm
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): cm
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): um
  misc_feature (18)..(19): Phosphorothioate bond
  modified_base (19)..(19): um
  misc_feature (19)..(20): Phosphorothioate bond
  modified_base (20)..(20): cm
cuuucuccuccucuccuuuc

SEQ ID NO: 221 - RNA, 15 nt, Artificial Sequence
  DKLS951212
  modified_base (1)..(1): um
  misc_feature (1)..(2): Phosphorothioate bond
  modified_base (2)..(2): cm
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): um
  misc_feature (5)..(6): Phosphorothioate bond
  modified_base (6)..(6): cm
  misc_feature (6)..(7): Phosphorothioate bond
  modified_base (7)..(7): um
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): um
uccuucucucccuuu

SEQ ID NO: 222 - RNA, 15 nt, Artificial Sequence
  DKLS679059
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): um
  misc_feature (3)..(4): Phosphorothioate bond
  modified_base (4)..(4): um
  misc_feature (4)..(5): Phosphorothioate bond
  modified_base (5)..(5): cm
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): cm
  misc_feature (13)..(14): Phosphorothioate bond
  modified_base (14)..(14): um
  misc_feature (14)..(15): Phosphorothioate bond
  modified_base (15)..(15): cm
cuuucuccuccucuc

SEQ ID NO: 223 - RNA, 20 nt, Artificial Sequence
  DKLS802578
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): um
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): gm
gugccuguuaucacgcucug

SEQ ID NO: 224 - RNA, 20 nt, Artificial Sequence
  DKLS410263
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): am
  misc_feature (12)..(13): Phosphorothioate bond
  modified_base (13)..(13): um
  misc_feature (13)..(14): Phosphorothioate bond
  modified_base (14)..(14): am
  misc_feature (14)..(15): Phosphorothioate bond
  modified_base (15)..(15): am
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): am
  misc_feature (18)..(19): Phosphorothioate bond
  modified_base (19)..(19): gm
  misc_feature (19)..(20): Phosphorothioate bond
  modified_base (20)..(20): gm
cagaggcagcaauaagaagg

SEQ ID NO: 225 - RNA, 21 nt, Artificial Sequence
  DKLS551191
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): am
  misc_feature (9)..(10): Phosphorothioate bond
  modified_base (10)..(10): gm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): gm
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): cm
  misc_feature (20)..(21): Phosphorothioate bond
  modified_base (21)..(21): gm
cgugacgaaggagucgucacg

SEQ ID NO: 226 - RNA, 20 nt, Artificial Sequence
  DKLS540345
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): um
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): gm
cuguacgcgcgaacguacag

SEQ ID NO: 227 - RNA, 20 nt, Artificial Sequence
  DKLS885676
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): gm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): um
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): gm
cuguacgaggagacguacag

SEQ ID NO: 228 - RNA, 22 nt, Artificial Sequence
  DKLS629224
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): gm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): cm
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): gm
  misc_feature (19)..(20): Phosphorothioate bond
  modified_base (20)..(20): am
  misc_feature (20)..(21): Phosphorothioate bond
  modified_base (21)..(21): cm
  misc_feature (21)..(22): Phosphorothioate bond
  modified_base (22)..(22): um
agucgcgcgggaugacgcgacu

SEQ ID NO: 229 - RNA, 21 nt, Artificial Sequence
  DKLS482695
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): cm
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): cm
  misc_feature (20)..(21): Phosphorothioate bond
  modified_base (21)..(21): gm
cgugacgacuccuucgucacg

SEQ ID NO: 230 - RNA, 20 nt, Artificial Sequence
  DKLS546051
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): um
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): gm
cuguacguucgcgcguacag

SEQ ID NO: 231 - RNA, 20 nt, Artificial Sequence
  DKLS574356
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): um
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): gm
cuguacgucuccucguacag

SEQ ID NO: 232 - RNA, 22 nt, Artificial Sequence
  DKLS580658
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): cm
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): gm
  misc_feature (19)..(20): Phosphorothioate bond
  modified_base (20)..(20): am
  misc_feature (20)..(21): Phosphorothioate bond
  modified_base (21)..(21): cm
  misc_feature (21)..(22): Phosphorothioate bond
  modified_base (22)..(22): um
agucgcgucaucccgcgcgacu

SEQ ID NO: 233 - RNA, 25 nt, Artificial Sequence
  DKLS389392
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): um
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): am
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (16)..(16): am
  misc_feature (16)..(17): Phosphorothioate bond
  modified_base (17)..(17): gm
  misc_feature (17)..(18): Phosphorothioate bond
  modified_base (18)..(18): um
  misc_feature (18)..(19): Phosphorothioate bond
  modified_base (19)..(19): cm
  misc_feature (19)..(20): Phosphorothioate bond
  modified_base (20)..(20): gm
  misc_feature (20)..(21): Phosphorothioate bond
  modified_base (21)..(21): um
  misc_feature (21)..(22): Phosphorothioate bond
  modified_base (22)..(22): cm
  misc_feature (22)..(23): Phosphorothioate bond
  modified_base (23)..(23): am
  misc_feature (23)..(24): Phosphorothioate bond
  modified_base (24)..(24): cm
  misc_feature (24)..(25): Phosphorothioate bond
  modified_base (25)..(25): gm
gaagcgugacgaaggagucgucacg

SEQ ID NO: 234 - RNA, 25 nt, Artificial Sequence
  DKLS379914
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): um
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): cm
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): um
  misc_feature (18)..(19): Phosphorothioate bond
  modified_base (19)..(19): cm
  misc_feature (19)..(20): Phosphorothioate bond
  modified_base (20)..(20): gm
  misc_feature (20)..(21): Phosphorothioate bond
  modified_base (21)..(21): um
  misc_feature (21)..(22): Phosphorothioate bond
  modified_base (22)..(22): cm
  misc_feature (22)..(23): Phosphorothioate bond
  modified_base (23)..(23): am
  misc_feature (23)..(24): Phosphorothioate bond
  modified_base (24)..(24): cm
  misc_feature (24)..(25): Phosphorothioate bond
  modified_base (25)..(25): gm
gaagcgugacgacuccuucgucacg

SEQ ID NO: 235 - RNA, 25 nt, Artificial Sequence
  DKLS872305
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): am
  misc_feature (9)..(10): Phosphorothioate bond
  modified_base (10)..(10): gm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): gm
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): cm
  misc_feature (20)..(21): Phosphorothioate bond
  modified_base (21)..(21): gm
  misc_feature (21)..(22): Phosphorothioate bond
  modified_base (22)..(22): gm
  misc_feature (22)..(23): Phosphorothioate bond
  modified_base (23)..(23): am
  misc_feature (23)..(24): Phosphorothioate bond
  modified_base (24)..(24): am
  misc_feature (24)..(25): Phosphorothioate bond
  modified_base (25)..(25): gm
cgugacgaaggagucgucacggaag

SEQ ID NO: 236 - RNA, 25 nt, Artificial Sequence
  DKLS361530
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): cm
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): cm
  misc_feature (20)..(21): Phosphorothioate bond
  modified_base (21)..(21): gm
  misc_feature (21)..(22): Phosphorothioate bond
  modified_base (22)..(22): gm
  misc_feature (22)..(23): Phosphorothioate bond
  modified_base (23)..(23): am
  misc_feature (23)..(24): Phosphorothioate bond
  modified_base (24)..(24): am
  misc_feature (24)..(25): Phosphorothioate bond
  modified_base (25)..(25): gm
cgugacgacuccuucgucacggaag

SEQ ID NO: 237 - RNA, 20 nt, Artificial Sequence
  DKLS323181
  modified_base (1)..(1): am
  misc_feature (1)..(2): Phosphorothioate bond
  modified_base (2)..(2): cm
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): am
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): am
  misc_feature (12)..(13): Phosphorothioate bond
  modified_base (13)..(13): am
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): am
accgaacaauaaauccacua

SEQ ID NO: 238 - RNA, 20 nt, Artificial Sequence
  DKLS568543
  modified_base (1)..(1): um
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): um
  misc_feature (4)..(5): Phosphorothioate bond
  modified_base (5)..(5): gm
  misc_feature (5)..(6): Phosphorothioate bond
  modified_base (6)..(6): um
  misc_feature (6)..(7): Phosphorothioate bond
  modified_base (7)..(7): am
  misc_feature (7)..(8): Phosphorothioate bond
  modified_base (8)..(8): um
  misc_feature (8)..(9): Phosphorothioate bond
  modified_base (9)..(9): gm
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): um
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): gm
  misc_feature (17)..(18): Phosphorothioate bond
  modified_base (18)..(18): am
  misc_feature (18)..(19): Phosphorothioate bond
  modified_base (19)..(19): am
  misc_feature (19)..(20): Phosphorothioate bond
  modified_base (20)..(20): am
uguuguauguccgugcgaaa

SEQ ID NO: 239 - RNA, 20 nt, Artificial Sequence
  DKLS565265
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): cm
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): gm
  misc_feature (17)..(18): Phosphorothioate bond
  modified_base (18)..(18): um
  misc_feature (18)..(19): Phosphorothioate bond
  modified_base (19)..(19): um
  misc_feature (19)..(20): Phosphorothioate bond
  modified_base (20)..(20): cm
cggaccgugcuccacgguuc

SEQ ID NO: 240 - RNA, 20 nt, Artificial Sequence
  DKLS608727
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): um
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): um
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): am
  misc_feature (18)..(19): Phosphorothioate bond
  modified_base (19)..(19): um
  misc_feature (19)..(20): Phosphorothioate bond
  modified_base (20)..(20): um
guuagaccguacuguguauu

SEQ ID NO: 241 - RNA, 20 nt, Artificial Sequence
  DKLS607664
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): am
  misc_feature (6)..(7): Phosphorothioate bond
  modified_base (7)..(7): am
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): um
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (16)..(16): um
  misc_feature (16)..(17): Phosphorothioate bond
  modified_base (17)..(17): cm
  misc_feature (17)..(18): Phosphorothioate bond
  modified_base (18)..(18): am
  misc_feature (18)..(19): Phosphorothioate bond
  modified_base (19)..(19): cm
  misc_feature (19)..(20): Phosphorothioate bond
  modified_base (20)..(20): gm
ggagcaacguucgggucacg

SEQ ID NO: 242 - RNA, 20 nt, Artificial Sequence
  DKLS603765
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): um
  misc_feature (16)..(17): Phosphorothioate bond
  modified_base (17)..(17): um
  misc_feature (17)..(18): Phosphorothioate bond
  modified_base (18)..(18): am
  misc_feature (18)..(19): Phosphorothioate bond
  modified_base (19)..(19): cm
  misc_feature (19)..(20): Phosphorothioate bond
  modified_base (20)..(20): gm
cucgcuggagccaucuuacg

SEQ ID NO: 243 - RNA, 20 nt, Artificial Sequence
  DKLS557745
  modified_base (1)..(1): am
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): cm
  misc_feature (17)..(18): Phosphorothioate bond
  modified_base (18)..(18): am
  misc_feature (18)..(19): Phosphorothioate bond
  modified_base (19)..(19): um
  misc_feature (19)..(20): Phosphorothioate bond
  modified_base (20)..(20): cm
aacuaagucgccaccgcauc

SEQ ID NO: 244 - RNA, 20 nt, Artificial Sequence
  DKLS601882
  modified_base (1)..(1): am
  misc_feature (1)..(2): Phosphorothioate bond
  modified_base (2)..(2): um
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): um
  misc_feature (6)..(7): Phosphorothioate bond
  modified_base (7)..(7): am
  misc_feature (7)..(8): Phosphorothioate bond
  modified_base (8)..(8): um
  misc_feature (8)..(9): Phosphorothioate bond
  modified_base (9)..(9): gm
  misc_feature (9)..(10): Phosphorothioate bond
  modified_base (10)..(10): am
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): am
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): gm
auucguaugagaacuaucug

SEQ ID NO: 245 - RNA, 20 nt, Artificial Sequence
  DKLS596033
  modified_base (1)..(1): am
  misc_feature (1)..(2): Phosphorothioate bond
  modified_base (2)..(2): am
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): gm
  misc_feature (11)..(12): Phosphorothioate bond
  modified_base (12)..(12): um
  misc_feature (12)..(13): Phosphorothioate bond
  modified_base (13)..(13): cm
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): um
  misc_feature (18)..(19): Phosphorothioate bond
  modified_base (19)..(19): am
  misc_feature (19)..(20): Phosphorothioate bond
  modified_base (20)..(20): um
aaugcggucgguccgcauau

SEQ ID NO: 246 - RNA, 20 nt, Artificial Sequence
  DKLS595384
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): am
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): cm
  misc_feature (13)..(14): Phosphorothioate bond
  modified_base (14)..(14): um
  misc_feature (14)..(15): Phosphorothioate bond
  modified_base (15)..(15): um
  misc_feature (15)..(16): Phosphorothioate bond
  modified_base (16)..(16): am
  misc_feature (16)..(17): Phosphorothioate bond
  modified_base (17)..(17): gm
  misc_feature (17)..(18): Phosphorothioate bond
  modified_base (18)..(18): um
  misc_feature (18)..(19): Phosphorothioate bond
  modified_base (19)..(19): um
  misc_feature (19)..(20): Phosphorothioate bond
  modified_base (20)..(20): gm
cagagggcaucgcuuaguug

SEQ ID NO: 247 - RNA, 20 nt, Artificial Sequence
  DKLS590665
  modified_base (1)..(1): um
  misc_feature (1)..(2): Phosphorothioate bond
  modified_base (2)..(2): cm
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): gm
  misc_feature (5)..(6): Phosphorothioate bond
  modified_base (6)..(6): am
  misc_feature (6)..(7): Phosphorothioate bond
  modified_base (7)..(7): um
  misc_feature (7)..(8): Phosphorothioate bond
  modified_base (8)..(8): am
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): am
  misc_feature (12)..(13): Phosphorothioate bond
  modified_base (13)..(13): am
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): cm
ucgugauaucuaaggugccc

SEQ ID NO: 248 - RNA, 20 nt, Artificial Sequence
  DKLS590552
  modified_base (1)..(1): um
  misc_feature (1)..(2): Phosphorothioate bond
  modified_base (2)..(2): cm
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): um
  misc_feature (5)..(6): Phosphorothioate bond
  modified_base (6)..(6): um
  misc_feature (6)..(7): Phosphorothioate bond
  modified_base (7)..(7): um
  misc_feature (7)..(8): Phosphorothioate bond
  modified_base (8)..(8): um
  misc_feature (8)..(9): Phosphorothioate bond
  modified_base (9)..(9): am
  misc_feature (9)..(10): Phosphorothioate bond
  modified_base (10)..(10): um
  misc_feature (10)..(11): Phosphorothioate bond
  modified_base (11)..(11): um
  misc_feature (11)..(12): Phosphorothioate bond
  modified_base (12)..(12): um
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): gm
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): gm
uccuuuuuauuuuucgggug

SEQ ID NO: 249 - RNA, 20 nt, Artificial Sequence
  DKLS590093
  modified_base (1)..(1): am
  misc_feature (1)..(2): Phosphorothioate bond
  modified_base (2)..(2): cm
  misc_feature (2)..(3): Phosphorothioate bond
  modified_base (3)..(3): um
  misc_feature (3)..(4): Phosphorothioate bond
  modified_base (4)..(4): um
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): um
  misc_feature (10)..(11): Phosphorothioate bond
  modified_base (11)..(11): gm
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): am
  misc_feature (16)..(17): Phosphorothioate bond
  modified_base (17)..(17): cm
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): gm
acuugcaagugcucgacgag

SEQ ID NO: 250 - RNA, 20 nt, Artificial Sequence
  DKLS587566
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): um
  misc_feature (7)..(8): Phosphorothioate bond
  modified_base (8)..(8): am
  misc_feature (8)..(9): Phosphorothioate bond
  modified_base (9)..(9): cm
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): um
  misc_feature (18)..(19): Phosphorothioate bond
  modified_base (19)..(19): um
  misc_feature (19)..(20): Phosphorothioate bond
  modified_base (20)..(20): cm
gggcgcuacuacggucauuc

SEQ ID NO: 251 - RNA, 20 nt, Artificial Sequence
  DKLS586797
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): cm
  misc_feature (6)..(7): Phosphorothioate bond
  modified_base (7)..(7): um
  misc_feature (7)..(8): Phosphorothioate bond
  modified_base (8)..(8): gm
  misc_feature (8)..(9): Phosphorothioate bond
  modified_base (9)..(9): gm
  misc_feature (9)..(10): Phosphorothioate bond
  modified_base (10)..(10): um
  misc_feature (10)..(11): Phosphorothioate bond
  modified_base (11)..(11): um
  misc_feature (11)..(12): Phosphorothioate bond
  modified_base (12)..(12): um
  misc_feature (12)..(13): Phosphorothioate bond
  modified_base (13)..(13): am
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): gm
  misc_feature (17)..(18): Phosphorothioate bond
  modified_base (18)..(18): um
  misc_feature (18)..(19): Phosphorothioate bond
  modified_base (19)..(19): cm
  misc_feature (19)..(20): Phosphorothioate bond
  modified_base (20)..(20): am
cgccucugguuuaggcguca

SEQ ID NO: 252 - RNA, 20 nt, Artificial Sequence
  DKLS582677
  modified_base (1)..(1): um
  misc_feature (1)..(2): Phosphorothioate bond
  modified_base (2)..(2): am
  misc_feature (2)..(3): Phosphorothioate bond
  modified_base (3)..(3): um
  misc_feature (3)..(4): Phosphorothioate bond
  modified_base (4)..(4): um
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): um
  misc_feature (10)..(11): Phosphorothioate bond
  modified_base (11)..(11): um
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): um
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): gm
  misc_feature (17)..(18): Phosphorothioate bond
  modified_base (18)..(18): um
  misc_feature (18)..(19): Phosphorothioate bond
  modified_base (19)..(19): am
  misc_feature (19)..(20): Phosphorothioate bond
  modified_base (20)..(20): gm
uauugccgauugguggguag

SEQ ID NO: 253 - RNA, 20 nt, Artificial Sequence
  DKLS546680
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): am
  misc_feature (4)..(5): Phosphorothioate bond
  modified_base (5)..(5): gm
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): um
  misc_feature (16)..(17): Phosphorothioate bond
  modified_base (17)..(17): am
  misc_feature (17)..(18): Phosphorothioate bond
  modified_base (18)..(18): um
  misc_feature (18)..(19): Phosphorothioate bond
  modified_base (19)..(19): gm
  misc_feature (19)..(20): Phosphorothioate bond
  modified_base (20)..(20): gm
gacagacaguaggacuaugg

SEQ ID NO: 254 - RNA, 20 nt, Artificial Sequence
  DKLS530372
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): um
  misc_feature (7)..(8): Phosphorothioate bond
  modified_base (8)..(8): um
  misc_feature (8)..(9): Phosphorothioate bond
  modified_base (9)..(9): um
  misc_feature (9)..(10): Phosphorothioate bond
  modified_base (10)..(10): um
  misc_feature (10)..(11): Phosphorothioate bond
  modified_base (11)..(11): um
  misc_feature (11)..(12): Phosphorothioate bond
  modified_base (12)..(12): am
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): cm
  misc_feature (15)..(16): Phosphorothioate bond
  modified_base (16)..(16): am
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): am
ccgcccuuuuuauccaacca

SEQ ID NO: 255 - RNA, 20 nt, Artificial Sequence
  DKLS519203
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): cm
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): am
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): am
ccgcugccgccccucaacua

SEQ ID NO: 256 - RNA, 20 nt, Artificial Sequence
  DKLS711434
  modified_base (1)..(1): um
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): gm
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): gm
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): um
  misc_feature (18)..(19): Phosphorothioate bond
  modified_base (19)..(19): cm
  misc_feature (19)..(20): Phosphorothioate bond
  modified_base (20)..(20): am
uucugucgagucacuuguca

SEQ ID NO: 257 - RNA, 20 nt, Artificial Sequence
  DKLS520505
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): am
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): um
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): am
gacgggcccaagguucucca

SEQ ID NO: 258 - RNA, 20 nt, Artificial Sequence
  DKLS827594
  modified_base (1)..(1): um
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): um
  misc_feature (6)..(7): Phosphorothioate bond
  modified_base (7)..(7): cm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): cm
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): um
  misc_feature (18)..(19): Phosphorothioate bond
  modified_base (19)..(19): cm
  misc_feature (19)..(20): Phosphorothioate bond
  modified_base (20)..(20): gm
uuccgucaggcucggguucg

SEQ ID NO: 259 - RNA, 20 nt, Artificial Sequence
  DKLS775409
  modified_base (1)..(1): um
  misc_feature (1)..(2): Phosphorothioate bond
  modified_base (2)..(2): cm
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): um
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): am
  misc_feature (12)..(13): Phosphorothioate bond
  modified_base (13)..(13): am
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): gm
  misc_feature (19)..(20): Phosphorothioate bond
  modified_base (20)..(20): um
ucguuugaggcaagaugcgu

SEQ ID NO: 260 - RNA, 20 nt, Artificial Sequence
  DKLS865397
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): gm
  misc_feature (5)..(6): Phosphorothioate bond
  modified_base (6)..(6): um
  misc_feature (6)..(7): Phosphorothioate bond
  modified_base (7)..(7): am
  misc_feature (7)..(8): Phosphorothioate bond
  modified_base (8)..(8): um
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): um
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): am
  misc_feature (18)..(19): Phosphorothioate bond
  modified_base (19)..(19): gm
  misc_feature (19)..(20): Phosphorothioate bond
  modified_base (20)..(20): gm
guguguauucgugggcuagg

SEQ ID NO: 261 - RNA, 20 nt, Artificial Sequence
  DKLS520022
  modified_base (1)..(1): um
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): um
  misc_feature (5)..(6): Phosphorothioate bond
  modified_base (6)..(6): cm
  misc_feature (6)..(7): Phosphorothioate bond
  modified_base (7)..(7): um
  misc_feature (7)..(8): Phosphorothioate bond
  modified_base (8)..(8): am
  misc_feature (8)..(9): Phosphorothioate bond
  modified_base (9)..(9): um
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): cm
  misc_feature (17)..(18): Phosphorothioate bond
  modified_base (18)..(18): am
  misc_feature (18)..(19): Phosphorothioate bond
  modified_base (19)..(19): gm
  misc_feature (19)..(20): Phosphorothioate bond
  modified_base (20)..(20): gm
uugaucuauucuuucgcagg

SEQ ID NO: 262 - RNA, 20 nt, Artificial Sequence
  DKLS463500
  modified_base (1)..(1): um
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): am
  misc_feature (12)..(13): Phosphorothioate bond
  modified_base (13)..(13): am
  misc_feature (13)..(14): Phosphorothioate bond
  modified_base (14)..(14): am
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): gm
  misc_feature (19)..(20): Phosphorothioate bond
  modified_base (20)..(20): cm
uagccacccauaaaucacgc

SEQ ID NO: 263 - RNA, 20 nt, Artificial Sequence
  DKLS784557
  modified_base (1)..(1): am
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): um
  misc_feature (7)..(8): Phosphorothioate bond
  modified_base (8)..(8): um
  misc_feature (8)..(9): Phosphorothioate bond
  modified_base (9)..(9): um
  misc_feature (9)..(10): Phosphorothioate bond
  modified_base (10)..(10): gm
  misc_feature (10)..(11): Phosphorothioate bond
  modified_base (11)..(11): um
  misc_feature (11)..(12): Phosphorothioate bond
  modified_base (12)..(12): am
  misc_feature (12)..(13): Phosphorothioate bond
  modified_base (13)..(13): gm
  misc_feature (13)..(14): Phosphorothioate bond
  modified_base (14)..(14): cm
  misc_feature (14)..(15): Phosphorothioate bond
  modified_base (15)..(15): am
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): cm
aaggaguuuguagcacacuc

SEQ ID NO: 264 - RNA, 20 nt, Artificial Sequence
  DKLS484519
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): am
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): um
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): am
  misc_feature (15)..(16): Phosphorothioate bond
  modified_base (16)..(16): um
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): gm
cgcauaugaaacucauacug

SEQ ID NO: 265 - RNA, 20 nt, Artificial Sequence
  DKLS831379
  modified_base (1)..(1): um
  misc_feature (1)..(2): Phosphorothioate bond
  modified_base (2)..(2): am
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): um
  misc_feature (11)..(12): Phosphorothioate bond
  modified_base (12)..(12): um
  misc_feature (12)..(13): Phosphorothioate bond
  modified_base (13)..(13): gm
  misc_feature (13)..(14): Phosphorothioate bond
  modified_base (14)..(14): um
  misc_feature (14)..(15): Phosphorothioate bond
  modified_base (15)..(15): am
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): cm
  misc_feature (19)..(20): Phosphorothioate bond
  modified_base (20)..(20): am
uaucagcccguuguacagca

SEQ ID NO: 266 - RNA, 20 nt, Artificial Sequence
  DKLS936805
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): am
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): um
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): am
  misc_feature (17)..(18): Phosphorothioate bond
  modified_base (18)..(18): um
  misc_feature (18)..(19): Phosphorothioate bond
  modified_base (19)..(19): um
  misc_feature (19)..(20): Phosphorothioate bond
  modified_base (20)..(20): um
gcaaaacgucgggguuauuu

SEQ ID NO: 267 - RNA, 20 nt, Artificial Sequence
  DKLS834800
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): um
  misc_feature (3)..(4): Phosphorothioate bond
  modified_base (4)..(4): um
  misc_feature (4)..(5): Phosphorothioate bond
  modified_base (5)..(5): um
  misc_feature (5)..(6): Phosphorothioate bond
  modified_base (6)..(6): um
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): um
  misc_feature (14)..(15): Phosphorothioate bond
  modified_base (15)..(15): gm
  misc_feature (15)..(16): Phosphorothioate bond
  modified_base (16)..(16): am
  misc_feature (16)..(17): Phosphorothioate bond
  modified_base (17)..(17): um
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): am
ccuuuugcccucgugaugaa

SEQ ID NO: 268 - RNA, 20 nt, Artificial Sequence
  DKLS807309
  modified_base (1)..(1): um
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): um
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): am
  misc_feature (15)..(16): Phosphorothioate bond
  modified_base (16)..(16): cm
  misc_feature (16)..(17): Phosphorothioate bond
  modified_base (17)..(17): cm
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): um
uugccguccgucucacccuu

SEQ ID NO: 269 - RNA, 20 nt, Artificial Sequence
  DKLS178323
  modified_base (1)..(1): am
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): cm
  misc_feature (13)..(14): Phosphorothioate bond
  modified_base (14)..(14): um
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): cm
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): am
augcuaggagcucugccgaa

SEQ ID NO: 270 - RNA, 20 nt, Artificial Sequence
  DKLS629418
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): um
  misc_feature (16)..(17): Phosphorothioate bond
  modified_base (17)..(17): cm
  misc_feature (17)..(18): Phosphorothioate bond
  modified_base (18)..(18): um
  misc_feature (18)..(19): Phosphorothioate bond
  modified_base (19)..(19): gm
  misc_feature (19)..(20): Phosphorothioate bond
  modified_base (20)..(20): um
cugcacccgacgaacucugu

SEQ ID NO: 271 - RNA, 20 nt, Artificial Sequence
  DKLS687192
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): am
  misc_feature (16)..(17): Phosphorothioate bond
  modified_base (17)..(17): um
  misc_feature (17)..(18): Phosphorothioate bond
  modified_base (18)..(18): um
  misc_feature (18)..(19): Phosphorothioate bond
  modified_base (19)..(19): gm
  misc_feature (19)..(20): Phosphorothioate bond
  modified_base (20)..(20): um
ccgaccacggcgggaauugu

SEQ ID NO: 272 - RNA, 20 nt, Artificial Sequence
  DKLS706542
  modified_base (1)..(1): um
  misc_feature (1)..(2): Phosphorothioate bond
  modified_base (2)..(2): um
  misc_feature (2)..(3): Phosphorothioate bond
  modified_base (3)..(3): um
  misc_feature (3)..(4): Phosphorothioate bond
  modified_base (4)..(4): um
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): am
  misc_feature (12)..(13): Phosphorothioate bond
  modified_base (13)..(13): am
  misc_feature (13)..(14): Phosphorothioate bond
  modified_base (14)..(14): am
  misc_feature (14)..(15): Phosphorothioate bond
  modified_base (15)..(15): am
  misc_feature (15)..(16): Phosphorothioate bond
  modified_base (16)..(16): am
  misc_feature (16)..(17): Phosphorothioate bond
  modified_base (17)..(17): um
  misc_feature (17)..(18): Phosphorothioate bond
  modified_base (18)..(18): am
  misc_feature (18)..(19): Phosphorothioate bond
  modified_base (19)..(19): am
  misc_feature (19)..(20): Phosphorothioate bond
  modified_base (20)..(20): gm
uuuuaagcgcaaaaaauaag

SEQ ID NO: 273 - RNA, 20 nt, Artificial Sequence
  DKLS700850
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): um
  misc_feature (7)..(8): Phosphorothioate bond
  modified_base (8)..(8): gm
  misc_feature (8)..(9): Phosphorothioate bond
  modified_base (9)..(9): gm
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): gm
  misc_feature (12)..(13): Phosphorothioate bond
  modified_base (13)..(13): cm
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): gm
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): gm
cgcuggugggcgcggcggag

SEQ ID NO: 274 - RNA, 20 nt, Artificial Sequence
  DKLS792825
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): am
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): am
  misc_feature (9)..(10): Phosphorothioate bond
  modified_base (10)..(10): um
  misc_feature (10)..(11): Phosphorothioate bond
  modified_base (11)..(11): gm
  misc_feature (11)..(12): Phosphorothioate bond
  modified_base (12)..(12): um
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): cm
  misc_feature (15)..(16): Phosphorothioate bond
  modified_base (16)..(16): um
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): um
cgcacgguauguuccuaguu

SEQ ID NO: 275 - RNA, 20 nt, Artificial Sequence
  DKLS792598
  modified_base (1)..(1): um
  misc_feature (1)..(2): Phosphorothioate bond
  modified_base (2)..(2): gm
  misc_feature (2)..(3): Phosphorothioate bond
  modified_base (3)..(3): cm
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): am
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): gm
  misc_feature (18)..(19): Phosphorothioate bond
  modified_base (19)..(19): gm
  misc_feature (19)..(20): Phosphorothioate bond
  modified_base (20)..(20): cm
ugccgggaccgauuaugggc

SEQ ID NO: 276 - RNA, 20 nt, Artificial Sequence
  DKLS821415
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): um
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): um
  misc_feature (11)..(12): Phosphorothioate bond
  modified_base (12)..(12): gm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (16)..(16): am
  misc_feature (16)..(17): Phosphorothioate bond
  modified_base (17)..(17): um
  misc_feature (17)..(18): Phosphorothioate bond
  modified_base (18)..(18): am
  misc_feature (18)..(19): Phosphorothioate bond
  modified_base (19)..(19): um
  misc_feature (19)..(20): Phosphorothioate bond
  modified_base (20)..(20): cm
guuggguccguguggauauc

SEQ ID NO: 277 - RNA, 20 nt, Artificial Sequence
  DKLS832163
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): cm
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): cm
  misc_feature (16)..(17): Phosphorothioate bond
  modified_base (17)..(17): am
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): cm
cuccucccuuacggacacuc

SEQ ID NO: 278 - RNA, 20 nt, Artificial Sequence
  DKLS696616
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): gm
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): cm
  misc_feature (13)..(14): Phosphorothioate bond
  modified_base (14)..(14): cm
  misc_feature (14)..(15): Phosphorothioate bond
  modified_base (15)..(15): cm
  misc_feature (15)..(16): Phosphorothioate bond
  modified_base (16)..(16): am
  misc_feature (16)..(17): Phosphorothioate bond
  modified_base (17)..(17): um
  misc_feature (17)..(18): Phosphorothioate bond
  modified_base (18)..(18): cm
  misc_feature (18)..(19): Phosphorothioate bond
  modified_base (19)..(19): um
  misc_feature (19)..(20): Phosphorothioate bond
  modified_base (20)..(20): cm
cucuuggcugagcccaucuc

SEQ ID NO: 279 - RNA, 20 nt, Artificial Sequence
  DKLS370480
  modified_base (1)..(1): gm
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): gm
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): am
  misc_feature (13)..(14): Phosphorothioate bond
  modified_base (14)..(14): um
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): gm
  misc_feature (18)..(19): Phosphorothioate bond
  modified_base (19)..(19): cm
  misc_feature (19)..(20): Phosphorothioate bond
  modified_base (20)..(20): cm
gucuccgucgucaugcugcc

SEQ ID NO: 280 - RNA, 20 nt, Artificial Sequence
  DKLS364918
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): gm
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): am
  misc_feature (12)..(13): Phosphorothioate bond
  modified_base (13)..(13): cm
  misc_feature (13)..(14): Phosphorothioate bond
  modified_base (14)..(14): um
  misc_feature (14)..(15): Phosphorothioate bond
  modified_base (15)..(15): gm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): um
  misc_feature (18)..(19): Phosphorothioate bond
  modified_base (19)..(19): gm
  misc_feature (19)..(20): Phosphorothioate bond
  modified_base (20)..(20): gm
cucggcaccccacuggaugg

SEQ ID NO: 281 - RNA, 20 nt, Artificial Sequence
  DKLS329687
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): gm
  misc_feature (5)..(6): Phosphorothioate bond
  modified_base (6)..(6): am
  misc_feature (6)..(7): Phosphorothioate bond
  modified_base (7)..(7): um
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): am
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): gm
  misc_feature (17)..(18): Phosphorothioate bond
  modified_base (18)..(18): am
  misc_feature (18)..(19): Phosphorothioate bond
  modified_base (19)..(19): um
  misc_feature (19)..(20): Phosphorothioate bond
  modified_base (20)..(20): cm
gaucgaucgaucgaucgauc

SEQ ID NO: 282 - RNA, 20 nt, Artificial Sequence
  DKLS636117
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): gm
  misc_feature (6)..(7): Phosphorothioate bond
  modified_base (7)..(7): um
  misc_feature (7)..(8): Phosphorothioate bond
  modified_base (8)..(8): gm
  misc_feature (8)..(9): Phosphorothioate bond
  modified_base (9)..(9): gm
  misc_feature (9)..(10): Phosphorothioate bond
  modified_base (10)..(10): gm
  misc_feature (10)..(11): Phosphorothioate bond
  modified_base (11)..(11): gm
  misc_feature (11)..(12): Phosphorothioate bond
  modified_base (12)..(12): um
  misc_feature (12)..(13): Phosphorothioate bond
  modified_base (13)..(13): gm
  misc_feature (13)..(14): Phosphorothioate bond
  modified_base (14)..(14): am
  misc_feature (14)..(15): Phosphorothioate bond
  modified_base (15)..(15): cm
  misc_feature (15)..(16): Phosphorothioate bond
  modified_base (16)..(16): cm
  misc_feature (16)..(17): Phosphorothioate bond
  modified_base (17)..(17): um
  misc_feature (17)..(18): Phosphorothioate bond
  modified_base (18)..(18): am
  misc_feature (18)..(19): Phosphorothioate bond
  modified_base (19)..(19): cm
  misc_feature (19)..(20): Phosphorothioate bond
  modified_base (20)..(20): cm
gagccguggggugaccuacc

SEQ ID NO: 283 - RNA, 20 nt, Artificial Sequence
  DKLS612200
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): um
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): am
  misc_feature (9)..(10): Phosphorothioate bond
  modified_base (10)..(10): um
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): am
  misc_feature (14)..(15): Phosphorothioate bond
  modified_base (15)..(15): am
  misc_feature (15)..(16): Phosphorothioate bond
  modified_base (16)..(16): am
  misc_feature (16)..(17): Phosphorothioate bond
  modified_base (17)..(17): cm
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): cm
gacuucgcaugggaaaccac

SEQ ID NO: 284 - RNA, 20 nt, Artificial Sequence
  DKLS860834
  modified_base (1)..(1): gm
  misc_feature (1)..(2): Phosphorothioate bond
  modified_base (2)..(2): gm
  misc_feature (2)..(3): Phosphorothioate bond
  modified_base (3)..(3): um
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): um
  misc_feature (7)..(8): Phosphorothioate bond
  modified_base (8)..(8): cm
  misc_feature (8)..(9): Phosphorothioate bond
  modified_base (9)..(9): gm
  misc_feature (9)..(10): Phosphorothioate bond
  modified_base (10)..(10): gm
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): am
  misc_feature (16)..(17): Phosphorothioate bond
  modified_base (17)..(17): cm
  misc_feature (17)..(18): Phosphorothioate bond
  modified_base (18)..(18): gm
  misc_feature (18)..(19): Phosphorothioate bond
  modified_base (19)..(19): gm
  misc_feature (19)..(20): Phosphorothioate bond
  modified_base (20)..(20): am
ggucacucggccugaacgga

SEQ ID NO: 285 - RNA, 20 nt, Artificial Sequence
  DKLS331584
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): um
  misc_feature (7)..(8): Phosphorothioate bond
  modified_base (8)..(8): cm
  misc_feature (8)..(9): Phosphorothioate bond
  modified_base (9)..(9): am
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): cm
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): cm
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): gm
  misc_feature (19)..(20): Phosphorothioate bond
  modified_base (20)..(20): gm
cggcugucaucuccgcgcgg

SEQ ID NO: 286 - RNA, 20 nt, Artificial Sequence
  DKLS645702
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
ccagugagccggacuugccu

SEQ ID NO: 287 - RNA, 20 nt, Artificial Sequence
  DKLS623338
  modified_base (1)..(1): cm
  misc_feature (1)..(2): Phosphorothioate bond
  modified_base (2)..(2): cm
  misc_feature (2)..(3): Phosphorothioate bond
  modified_base (3)..(3): am
  misc_feature (3)..(4): Phosphorothioate bond
  modified_base (4)..(4): gm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): cm
  misc_feature (18)..(19): Phosphorothioate bond
  modified_base (19)..(19): cm
  misc_feature (19)..(20): Phosphorothioate bond
  modified_base (20)..(20): um
ccagugagccggacuugccu

SEQ ID NO: 288 - RNA, 20 nt, Artificial Sequence
  DKLS409068
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): um
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): cm
  misc_feature (13)..(14): Phosphorothioate bond
  modified_base (14)..(14): um
  misc_feature (14)..(15): Phosphorothioate bond
  modified_base (15)..(15): um
  misc_feature (15)..(16): Phosphorothioate bond
  modified_base (16)..(16): um
  misc_feature (16)..(17): Phosphorothioate bond
  modified_base (17)..(17): gm
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): gm
cugaagcguacccuuuggug

SEQ ID NO: 289 - RNA, 20 nt, Artificial Sequence
  DKLS684387
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): cm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): cm
  misc_feature (12)..(13): Phosphorothioate bond
  modified_base (13)..(13): um
  misc_feature (13)..(14): Phosphorothioate bond
  modified_base (14)..(14): gm
  misc_feature (14)..(15): Phosphorothioate bond
  modified_base (15)..(15): cm
  misc_feature (15)..(16): Phosphorothioate bond
  modified_base (16)..(16): am
  misc_feature (16)..(17): Phosphorothioate bond
  modified_base (17)..(17): gm
  misc_feature (17)..(18): Phosphorothioate bond
  modified_base (18)..(18): gm
  misc_feature (18)..(19): Phosphorothioate bond
  modified_base (19)..(19): um
  misc_feature (19)..(20): Phosphorothioate bond
  modified_base (20)..(20): am
gaugaccuccccugcaggua

SEQ ID NO: 290 - RNA, 20 nt, Artificial Sequence
  DKLS484655
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): um
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): um
  misc_feature (10)..(11): Phosphorothioate bond
  modified_base (11)..(11): um
  misc_feature (11)..(12): Phosphorothioate bond
  modified_base (12)..(12): gm
  misc_feature (12)..(13): Phosphorothioate bond
  modified_base (13)..(13): cm
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): um
  misc_feature (16)..(17): Phosphorothioate bond
  modified_base (17)..(17): cm
  misc_feature (17)..(18): Phosphorothioate bond
  modified_base (18)..(18): gm
  misc_feature (18)..(19): Phosphorothioate bond
  modified_base (19)..(19): cm
  misc_feature (19)..(20): Phosphorothioate bond
  modified_base (20)..(20): gm
cucgggugauuacgaucgcg

SEQ ID NO: 291 - RNA, 20 nt, Artificial Sequence
  DKLS771111
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): am
  misc_feature (11)..(12): Phosphorothioate bond
  modified_base (12)..(12): um
  misc_feature (12)..(13): Phosphorothioate bond
  modified_base (13)..(13): gm
  misc_feature (13)..(14): Phosphorothioate bond
  modified_base (14)..(14): cm
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): gm
cagcucguccaugccgagag

SEQ ID NO: 292 - RNA, 20 nt, Artificial Sequence
  DKLS820087
  modified_base (1)..(1): am
  misc_feature (1)..(2): Phosphorothioate bond
  modified_base (2)..(2): cm
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): gm
  misc_feature (13)..(14): Phosphorothioate bond
  modified_base (14)..(14): cm
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): cm
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): gm
acgauagucccugccgcgag

SEQ ID NO: 293 - RNA, 20 nt, Artificial Sequence
  DKLS817322
  modified_base (1)..(1): um
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): um
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): gm
  misc_feature (7)..(8): Phosphorothioate bond
  modified_base (8)..(8): cm
  misc_feature (8)..(9): Phosphorothioate bond
  modified_base (9)..(9): um
  misc_feature (9)..(10): Phosphorothioate bond
  modified_base (10)..(10): um
  misc_feature (10)..(11): Phosphorothioate bond
  modified_base (11)..(11): am
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): cm
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): gm
uaguccgcuuacgccgagag

SEQ ID NO: 294 - RNA, 20 nt, Artificial Sequence
  DKLS675388
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): cm
  misc_feature (6)..(7): Phosphorothioate bond
  modified_base (7)..(7): cm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): um
  misc_feature (12)..(13): Phosphorothioate bond
  modified_base (13)..(13): cm
  misc_feature (13)..(14): Phosphorothioate bond
  modified_base (14)..(14): cm
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): am
  misc_feature (18)..(19): Phosphorothioate bond
  modified_base (19)..(19): am
  misc_feature (19)..(20): Phosphorothioate bond
  modified_base (20)..(20): gm
cugcuccuccuucccguaag

SEQ ID NO: 295 - RNA, 20 nt, Artificial Sequence
  DKLS827917
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): am
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): gm
  misc_feature (9)..(10): Phosphorothioate bond
  modified_base (10)..(10): gm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): am
  misc_feature (13)..(14): Phosphorothioate bond
  modified_base (14)..(14): cm
  misc_feature (14)..(15): Phosphorothioate bond
  modified_base (15)..(15): gm
  misc_feature (15)..(16): Phosphorothioate bond
  modified_base (16)..(16): um
  misc_feature (16)..(17): Phosphorothioate bond
  modified_base (17)..(17): cm
  misc_feature (17)..(18): Phosphorothioate bond
  modified_base (18)..(18): cm
  misc_feature (18)..(19): Phosphorothioate bond
  modified_base (19)..(19): am
  misc_feature (19)..(20): Phosphorothioate bond
  modified_base (20)..(20): um
cuacuggaggggacguccau

SEQ ID NO: 296 - DNA, 20 bp, Artificial Sequence
  DKLS843537
  modified_base (1)..(1): am
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): cm
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): tm
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): gm
  misc_feature (11)..(12): Phosphorothioate bond
  modified_base (12)..(12): gm
  misc_feature (12)..(13): Phosphorothioate bond
  modified_base (13)..(13): cm
  misc_feature (13)..(14): Phosphorothioate bond
  modified_base (14)..(14): tm
  misc_feature (14)..(15): Phosphorothioate bond
  modified_base (15)..(15): cm
  misc_feature (15)..(16): Phosphorothioate bond
  modified_base (16)..(16): am
  misc_feature (16)..(17): Phosphorothioate bond
  modified_base (17)..(17): cm
  misc_feature (17)..(18): Phosphorothioate bond
  modified_base (18)..(18): tm
  misc_feature (18)..(19): Phosphorothioate bond
  modified_base (19)..(19): gm
  misc_feature (19)..(20): Phosphorothioate bond
  modified_base (20)..(20): gm
aggcaagtccggctcactgg

SEQ ID NO: 297 - RNA, 20 nt, Artificial Sequence
  DKLS859480
  modified_base (1)..(1): cm
  misc_feature (1)..(2): Phosphorothioate bond
  modified_base (2)..(2): um
  misc_feature (2)..(3): Phosphorothioate bond
  modified_base (3)..(3): um
  misc_feature (3)..(4): Phosphorothioate bond
  modified_base (4)..(4): gm
  misc_feature (4)..(5): Phosphorothioate bond
  modified_base (5)..(5): gm
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): gm
  misc_feature (9)..(10): Phosphorothioate bond
  modified_base (10)..(10): um
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): am
  misc_feature (13)..(14): Phosphorothioate bond
  modified_base (14)..(14): gm
  misc_feature (14)..(15): Phosphorothioate bond
  modified_base (15)..(15): am
  misc_feature (15)..(16): Phosphorothioate bond
  modified_base (16)..(16): gm
  misc_feature (16)..(17): Phosphorothioate bond
  modified_base (17)..(17): gm
  misc_feature (17)..(18): Phosphorothioate bond
  modified_base (18)..(18): am
  misc_feature (18)..(19): Phosphorothioate bond
  modified_base (19)..(19): am
  misc_feature (19)..(20): Phosphorothioate bond
  modified_base (20)..(20): gm
cuuggggggucuagaggaag

SEQ ID NO: 298 - RNA, 20 nt, Artificial Sequence
  DKLS371273
  modified_base (1)..(1): cm
  misc_feature (1)..(2): Phosphorothioate bond
  modified_base (2)..(2): gm
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): um
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): am
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): am
  misc_feature (11)..(12): Phosphorothioate bond
  modified_base (12)..(12): gm
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): cm
  misc_feature (17)..(18): Phosphorothioate bond
  modified_base (18)..(18): am
  misc_feature (18)..(19): Phosphorothioate bond
  modified_base (19)..(19): gm
  misc_feature (19)..(20): Phosphorothioate bond
  modified_base (20)..(20): um
cggauggaaaaggguccagu

SEQ ID NO: 299 - RNA, 20 nt, Artificial Sequence
  DKLS658030
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): gm
  misc_feature (6)..(7): Phosphorothioate bond
  modified_base (7)..(7): gm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): am
  misc_feature (10)..(11): Phosphorothioate bond
  modified_base (11)..(11): um
  misc_feature (11)..(12): Phosphorothioate bond
  modified_base (12)..(12): gm
  misc_feature (12)..(13): Phosphorothioate bond
  modified_base (13)..(13): cm
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): gm
  misc_feature (16)..(17): Phosphorothioate bond
  modified_base (17)..(17): um
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): gm
gaggagggaaugccugugag

SEQ ID NO: 300 - RNA, 20 nt, Artificial Sequence
  DKLS506891
  modified_base (1)..(1): am
  misc_feature (1)..(2): Phosphorothioate bond
  modified_base (2)..(2): cm
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): am
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): gm
  misc_feature (9)..(10): Phosphorothioate bond
  modified_base (10)..(10): am
  misc_feature (10)..(11): Phosphorothioate bond
  modified_base (11)..(11): cm
  misc_feature (11)..(12): Phosphorothioate bond
  modified_base (12)..(12): am
  misc_feature (12)..(13): Phosphorothioate bond
  modified_base (13)..(13): um
  misc_feature (13)..(14): Phosphorothioate bond
  modified_base (14)..(14): um
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): gm
  misc_feature (17)..(18): Phosphorothioate bond
  modified_base (18)..(18): am
  misc_feature (18)..(19): Phosphorothioate bond
  modified_base (19)..(19): am
  misc_feature (19)..(20): Phosphorothioate bond
  modified_base (20)..(20): gm
accgaacggacauuucgaag

SEQ ID NO: 301 - RNA, 20 nt, Artificial Sequence
  DKLS665920
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): cm
  misc_feature (3)..(4): Phosphorothioate bond
  modified_base (4)..(4): gm
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): am
  misc_feature (7)..(8): Phosphorothioate bond
  modified_base (8)..(8): gm
  misc_feature (8)..(9): Phosphorothioate bond
  modified_base (9)..(9): um
  misc_feature (9)..(10): Phosphorothioate bond
  modified_base (10)..(10): am
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): cm
  misc_feature (15)..(16): Phosphorothioate bond
  modified_base (16)..(16): gm
  misc_feature (16)..(17): Phosphorothioate bond
  modified_base (17)..(17): cm
  misc_feature (17)..(18): Phosphorothioate bond
  modified_base (18)..(18): gm
  misc_feature (18)..(19): Phosphorothioate bond
  modified_base (19)..(19): cm
  misc_feature (19)..(20): Phosphorothioate bond
  modified_base (20)..(20): cm
gccgacaguagaggcgcgcc

SEQ ID NO: 302 - RNA, 20 nt, Artificial Sequence
  DKLS649218
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): am
  misc_feature (3)..(4): Phosphorothioate bond
  modified_base (4)..(4): cm
  misc_feature (4)..(5): Phosphorothioate bond
  modified_base (5)..(5): cm
  misc_feature (5)..(6): Phosphorothioate bond
  modified_base (6)..(6): cm
  misc_feature (6)..(7): Phosphorothioate bond
  modified_base (7)..(7): cm
  misc_feature (7)..(8): Phosphorothioate bond
  modified_base (8)..(8): cm
  misc_feature (8)..(9): Phosphorothioate bond
  modified_base (9)..(9): cm
  misc_feature (9)..(10): Phosphorothioate bond
  modified_base (10)..(10): am
  misc_feature (10)..(11): Phosphorothioate bond
  modified_base (11)..(11): gm
  misc_feature (11)..(12): Phosphorothioate bond
  modified_base (12)..(12): am
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): um
  misc_feature (15)..(16): Phosphorothioate bond
  modified_base (16)..(16): cm
  misc_feature (16)..(17): Phosphorothioate bond
  modified_base (17)..(17): cm
  misc_feature (17)..(18): Phosphorothioate bond
  modified_base (18)..(18): um
  misc_feature (18)..(19): Phosphorothioate bond
  modified_base (19)..(19): um
  misc_feature (19)..(20): Phosphorothioate bond
  modified_base (20)..(20): cm
gaaccccccagaucuccuuc

SEQ ID NO: 303 - RNA, 20 nt, Artificial Sequence
  DKLS991101
  modified_base (1)..(1): gm
  misc_feature (1)..(2): Phosphorothioate bond
  modified_base (2)..(2): am
  misc_feature (2)..(3): Phosphorothioate bond
  modified_base (3)..(3): gm
  misc_feature (3)..(4): Phosphorothioate bond
  modified_base (4)..(4): am
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): cm
  misc_feature (7)..(8): Phosphorothioate bond
  modified_base (8)..(8): gm
  misc_feature (8)..(9): Phosphorothioate bond
  modified_base (9)..(9): am
  misc_feature (9)..(10): Phosphorothioate bond
  modified_base (10)..(10): cm
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): gm
  misc_feature (13)..(14): Phosphorothioate bond
  modified_base (14)..(14): gm
  misc_feature (14)..(15): Phosphorothioate bond
  modified_base (15)..(15): gm
  misc_feature (15)..(16): Phosphorothioate bond
  modified_base (16)..(16): um
  misc_feature (16)..(17): Phosphorothioate bond
  modified_base (17)..(17): am
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): gm
gagaaccgacucggguagag

SEQ ID NO: 304 - RNA, 20 nt, Artificial Sequence
  DKLS789189
  modified_base (1)..(1): gm
  misc_feature (1)..(2): Phosphorothioate bond
  modified_base (2)..(2): cm
  misc_feature (2)..(3): Phosphorothioate bond
  modified_base (3)..(3): cm
  misc_feature (3)..(4): Phosphorothioate bond
  modified_base (4)..(4): um
  misc_feature (4)..(5): Phosphorothioate bond
  modified_base (5)..(5): am
  misc_feature (5)..(6): Phosphorothioate bond
  modified_base (6)..(6): cm
  misc_feature (6)..(7): Phosphorothioate bond
  modified_base (7)..(7): cm
  misc_feature (7)..(8): Phosphorothioate bond
  modified_base (8)..(8): um
  misc_feature (8)..(9): Phosphorothioate bond
  modified_base (9)..(9): um
  misc_feature (9)..(10): Phosphorothioate bond
  modified_base (10)..(10): um
  misc_feature (10)..(11): Phosphorothioate bond
  modified_base (11)..(11): um
  misc_feature (11)..(12): Phosphorothioate bond
  modified_base (12)..(12): cm
  misc_feature (12)..(13): Phosphorothioate bond
  modified_base (13)..(13): cm
  misc_feature (13)..(14): Phosphorothioate bond
  modified_base (14)..(14): cm
  misc_feature (14)..(15): Phosphorothioate bond
  modified_base (15)..(15): am
  misc_feature (15)..(16): Phosphorothioate bond
  modified_base (16)..(16): gm
  misc_feature (16)..(17): Phosphorothioate bond
  modified_base (17)..(17): gm
  misc_feature (17)..(18): Phosphorothioate bond
  modified_base (18)..(18): um
  misc_feature (18)..(19): Phosphorothioate bond
  modified_base (19)..(19): cm
  misc_feature (19)..(20): Phosphorothioate bond
  modified_base (20)..(20): am
gccuaccuuuucccagguca

SEQ ID NO: 305 - RNA, 20 nt, Artificial Sequence
  DKLS651753
  modified_base (1)..(1): cm
  misc_feature (1)..(2): Phosphorothioate bond
  modified_base (2)..(2): am
  misc_feature (2)..(3): Phosphorothioate bond
  modified_base (3)..(3): cm
  misc_feature (3)..(4): Phosphorothioate bond
  modified_base (4)..(4): cm
  misc_feature (4)..(5): Phosphorothioate bond
  modified_base (5)..(5): um
  misc_feature (5)..(6): Phosphorothioate bond
  modified_base (6)..(6): am
  misc_feature (6)..(7): Phosphorothioate bond
  modified_base (7)..(7): gm
  misc_feature (7)..(8): Phosphorothioate bond
  modified_base (8)..(8): um
  misc_feature (8)..(9): Phosphorothioate bond
  modified_base (9)..(9): cm
  misc_feature (9)..(10): Phosphorothioate bond
  modified_base (10)..(10): cm
  misc_feature (10)..(11): Phosphorothioate bond
  modified_base (11)..(11): cm
  misc_feature (11)..(12): Phosphorothioate bond
  modified_base (12)..(12): um
  misc_feature (12)..(13): Phosphorothioate bond
  modified_base (13)..(13): um
  misc_feature (13)..(14): Phosphorothioate bond
  modified_base (14)..(14): cm
  misc_feature (14)..(15): Phosphorothioate bond
  modified_base (15)..(15): cm
  misc_feature (15)..(16): Phosphorothioate bond
  modified_base (16)..(16): um
  misc_feature (16)..(17): Phosphorothioate bond
  modified_base (17)..(17): cm
  misc_feature (17)..(18): Phosphorothioate bond
  modified_base (18)..(18): gm
  misc_feature (18)..(19): Phosphorothioate bond
  modified_base (19)..(19): am
  misc_feature (19)..(20): Phosphorothioate bond
  modified_base (20)..(20): gm
caccuagucccuuccucgag

SEQ ID NO: 306 - DNA, 20 bp, Artificial Sequence
  DNA_In3E3
ccagugagccggacuugccu

SEQ ID NO: 307 - RNA, 20 nt, Artificial Sequence
  RNA_In3E3
ccagugagccggacuugccu

What is claimed is:

1. A method for inhibiting proliferation, survival or viability of a tumor cell, the method comprising introducing into the tumor cell a nucleic acid oligomer of up to 29 nucleobases in length, and comprising the nucleobase sequence set forth in SEQ ID NO:1.

2. The method of claim 1, wherein the tumor cell is selected from the group consisting of a cervical tumor cell, a bone tumor cell, a prostate tumor cell, a breast tumor cell, a lung tumor cell and a non-small cell lung tumor cell.

3. The method of claim 1, wherein the oligomer is not complexed with a complexing agent that facilitates uptake of the oligomer into the tumor cell.

4. The method of claim 1, wherein the oligomer is complexed with a complexing agent that facilitates uptake of the oligomer into the tumor cell.

5. The method of claim 4, wherein the complexing agent is a cationic lipid, peptide, polypeptide or non-biological cationic polymer.

6. The method of claim 4, wherein the complexing agent is a liposome.

7. A method for inhibiting proliferation, survival or viability of a tumor cell, the method comprising introducing into the tumor cell a nucleic acid oligomer consisting of the nucleobase sequence set forth in SEQ ID NO:1.

* * * * *